(12) United States Patent
Wang et al.

(10) Patent No.: US 8,039,210 B2
(45) Date of Patent: Oct. 18, 2011

(54) PROTEIN TYROSINE PHOSPHATASE MUTATIONS IN CANCERS

(75) Inventors: Zhenghe Wang, Baltimore, MD (US); Victor Velculescu, Dayton, MD (US); Kenneth W. Kinzler, Baltimore, MD (US); Bert Vogelstein, Baltimore, MD (US)

(73) Assignee: The Johns Hopkins University, Baltimore, MD (US)

( * ) Notice: Subject to any disclaimer, the term of this patent is extended or adjusted under 35 U.S.C. 154(b) by 598 days.

(21) Appl. No.: 11/596,349

(22) PCT Filed: May 16, 2005

(86) PCT No.: PCT/US2005/017105
§ 371 (c)(1), (2), (4) Date: Sep. 27, 2007

(87) PCT Pub. No.: WO2005/113824
PCT Pub. Date: Dec. 1, 2005

(65) Prior Publication Data
US 2008/0039417 A1  Feb. 14, 2008

Related U.S. Application Data

(60) Provisional application No. 60/571,436, filed on May 14, 2004.

(51) Int. Cl.
*C12Q 1/68* (2006.01)
(52) U.S. Cl. .......................................................... 435/6
(58) Field of Classification Search ........................ 435/6
See application file for complete search history.

(56) References Cited

U.S. PATENT DOCUMENTS 7,129,040 B2 * 10/2006 Steck et al. ...................... 435/4
7,504,222 B2 * 3/2009 Ayers et al. .................... 435/7.1

FOREIGN PATENT DOCUMENTS
WO  WO 00/75339 A1  12/2000

OTHER PUBLICATIONS

Andersen et al., FASEB J., 2004, Jan. 18: 8-30.*
Collins, Award Number: DAMD17-01-01-0500, US Army Medical Research and Material Command, Aug. 2002.*
Colozza et al., Annals Oncol., 2005, 16:1723-1739.*
Coradini et al., Curr. Opin. Obst. Gyn. 2004, 16:49-55.*
Lee et al., APMIS, 2007, 115: 47-51.*
Streuli, et al.: Distinct functional roles of the two intracellular phosphatase like domains of the receptor-linked protein tyrosine phosphatase LCA and LAR, The EMBO Journall, vol. 9, No. 8, pp. 2399-2407, 1990.
Yang, et al.: "Leukocyte Common Antigen-Related Tyrosine Phosphatase Receptor: Increased Expression and Neuronal-Type Splicing in Breast Cancer Cells and Tissue", Molecular Carcinogenesis, 1999, vol. 25, pp. 139-149.
Laforgia, et al.: Receptor protein-tyrosine phosphatase γ is a candidate tumor suppressor gene at human chromosome region 3p21, Proc. Nat'L Acad. Sci., USA, 1991, vol. 88, pp. 5036-5040.

* cited by examiner

*Primary Examiner* — Hong Sang
(74) *Attorney, Agent, or Firm* — Banner & Witcoff, Ltd.

(57) ABSTRACT

Tyrosine phosphorylation, regulated by protein tyrosine phosphatases (PTPs) and kinases (PTKs), is important in signaling pathways underlying tumorigenesis. A mutational analysis of the tyrosine phosphatase gene superfamily in human cancers identified 83 somatic mutations in six PTPs (PTPRF, PTPRG, PTPRT, PTPN3, PTPN13, PTPN14) affecting 26% of colorectal cancers and a smaller fraction of lung, breast and gastric cancers. Fifteen mutations were nonsense, frameshift or splice site alterations predicted to result in truncated proteins lacking phosphatase activity. Five missense mutations in the most commonly altered PTP (PTPRP) were biochemically examined and found to reduce phosphatase activity. Expression of wild-type but not a mutant PTPRT in human cancer cells inhibited cell growth. These observations suggest that the tyrosine phosphatase genes are tumor suppressor genes, regulating cellular pathways that may be amenable to therapeutic intervention.

11 Claims, 8 Drawing Sheets

Fig. 5

Mutations of the tyrosine phosphatome in human cancers

| Gene | Other names | Accession* | Group | No. of mutations (% tumors affected)# | Tumor type | Tumor | Nucleotide† | Amino Acid† | KRAS / BRAF Mutation** | Tyrosine Kinome Mutation** |
|---|---|---|---|---|---|---|---|---|---|---|
| PTPRT | RPTPrho | NM_133170 | RPTP | 27 (11%) colorectal cancers | colorectal | Hx104 | G625A / G3805A | A209T / V1269M | KRAS | none |
| | | hCT1955989 | | | colorectal | Co88 | G625A | A209T | KRAS | none |
| | | | | | colorectal | Hx29 | T743C | F248S | ND | MLK4 |
| | | | | | colorectal | Hx139 | T838C | Y280H | KRAS | none |
| | | | | | colorectal | Co76 | A1235T | Y412F | none | none |
| | | | | | colorectal | Hx111 | T1530G | N510K | BRAF | none |
| | | | | | colorectal | Co61 | C1814T | T605M | BRAF | none |
| | | | | | colorectal | Hx46 | T1943G | V648G | KRAS | none |
| | | | | | colorectal | Hx101 | C1894T / 3290del | R632X / frameshift | BRAF | none |
| | | | | | colorectal | Co80 | G2119A / A2780G | A707T / D927G | none | MLK4, GUCY2F |
| | | | | | colorectal | Co53 | C2120T / C3061T | A707V / R1021X | KRAS | none |
| | | | | | colorectal | Hx124 | T221C / T2123C | F74S / L708P | ND | GUCY2F |
| | | | | | colorectal | Cx27 | C2923T / LOH | R975X / LOH | none | none |
| | | | | | colorectal | Hx153 | C2959A | Q987K | KRAS | none |
| | | | | | colorectal | Hx53 | G3352C / C4103T | A1118P / T1368M | KRAS | none |
| | | | | | colorectal | Hx125 | A3383T | N1128I | ND | none |
| | | | | | colorectal | Hx12 | C3634T | R1212W | KRAS | none |
| | | | | | colorectal | Hx143 | A3775T | M1259L | KRAS | none |
| | | | | | colorectal | Hx138 | A1183G / A4052T | I395V / Y1351F | KRAS | none |
| | | | | | colorectal | Hx64 | C4103T | T1368M | KRAS | ND |
| | | | | | gastric | G8 | C1357T | R453C | ND | ND |
| | | | | 2 (17%) gastric cancers | gastric | G10 | A653C | K218T | ND | ND |
| | | | | | lung | L7 | G4037T | R1346L | ND | ND |
| | | | | 2 (18%) lung cancers | lung | L9 | G2369T | R790I | ND | ND |
| PTPRG | PTPG | NM_002841 | RPTP | 8 (5%) colorectal cancers | colorectal | Mx6 | C1082T | T361M | KRAS | none |
| | HPTPG | hCT14949 | | | colorectal | Cx10 | C1385T | A462V | KRAS | none |
| | RPTPG | | | | colorectal | Co59 | C1541T | T514M | none | none |
| | R-PTP-gamma | | | | colorectal | Hx101 | C1777T | R593W | BRAF | none |

Fig. 5 (continued)

| | | | | | | | | |
|---|---|---|---|---|---|---|---|---|
| | | | | | colorectal | Hx117 | A2864G | E955G | BRAF | none |
| | | | | | colorectal | Co85 | A2918G | Y973C | ND | NTRK2 |
| | | | | | colorectal | Co72 | C3934T | R1312W | BRAF | GUCY2F |
| | | | | | colorectal | Hx17 | A3976G / LOH | H1326V / LOH | KRAS | FES, GUCY2F |
| PTPRF | LAR | NM_002840 hCT16333 | RPTP | 6 (3%) colorectal cancers | colorectal | Co88 | C652T | R218C | KRAS | none |
| | | | | | colorectal | Hx96 | G1933A | G645R | none | none |
| | | | | | colorectal | Co30 | splice site | splice site | BRAF | none |
| | | | | | colorectal | Cx29 | G3119T | G1040V | BRAF | none |
| | | | | | colorectal | Cx27 | C3997T / LOH | R1333C / LOH | none | GUCY2F |
| | | | | | colorectal | Cx2 | G4168A | V1390I | KRAS | ND |
| | | | | 1 (9%) breast cancers | breast | B8 | 1159-1404substitution | 387-468substitution | ND | ND |
| | | | | 1 (9%) lung cancers | lung | L3 | C1142T / LOH | A381V / LOH | ND | ND |
| PTPN13 | PNP1 FAP-1 PTP1E PTPL1 PTPLE PTP-BAS PTP-BL | NM_080683 hCT1962353 | NRPTP | 19 (9%) colorectal cancers | colorectal | Co53 | C6G / G2854T | H2Q / E952X | KRAS | none |
| | | | | | colorectal | Co86 | 855insA | frameshift | KRAS | none |
| | | | | | colorectal | Co39 | 855del / G4426T | frameshift / G1476C | BRAF | FES |
| | | | | | colorectal | Cx2 | C1138T / G7329T | R380X / R2443I | KRAS | GUCY2F |
| | | | | | colorectal | Co80 | C1204T | R402X | none | MLK4, GUCY2F |
| | | | | | colorectal | Hx28 | G1328A | S443N | KRAS | none |
| | | | | | colorectal | Co61 | C1586A | A529D | BRAF | none |
| | | | | | colorectal | Co76 | C5071T | Q1691X | none | none |
| | | | | | colorectal | Hx60 | A6393T | K2131N | BRAF | ND |
| | | | | | colorectal | Hx96 | G6460C | D2154H | none | none |
| | | | | | colorectal | Co72 | C6613T / C7012T | R2205W / R2338X | BRAF | GUCY2F |
| | | | | | colorectal | Hx148 | C6837A | Y2279X | KRAS | ND |
| | | | | | colorectal | Co69 | T6920C | M2307T | none | none |
| | | | | | colorectal | Mx16 | A7372G | I2458V | none | none |
| | | | | | colorectal | C031 | A7422C | E2474D | BRAF | MLK4 |
| PTPN14 | PEZ PTP36 | NM_005401 hCT2261290 | NRPTP | 11 (6%) colorectal cancers | colorectal | Cx29 | C166A | L56M | BRAF | none |
| | | | | | colorectal | Co50 | G878A / LOH | R293Q / LOH | KRAS | none |
| | | | | | colorectal | Co83 | T940C | S314P | BRAF | none |
| | | | | | colorectal | Hx87 | A995G | Q332R | KRAS | none |
| | | | | | colorectal | Hx88 | G1472A | R491Q | KRAS | none |

Fig. 5 (continued)

| Gene | Accession | | Family | Sample type | Tumor | Nucleotide change | Amino acid change | KRAS | Other |
|---|---|---|---|---|---|---|---|---|---|
| | | | | colorectal | Hx141 | C1574T / C1897T | P525L / H633Y | KRAS | none |
| | | | | colorectal | Co95 | C1583T | P528L | ND | NTRK2 |
| | | | | colorectal | Mx23 | C1970T | T657M | KRAS | GUCY2F |
| | | | | colorectal | Hx35 | G2649T / LOH | E883D / LOH | none | none |
| | | | | colorectal | Hx60 | C3203T | T1068M | BRAF | ND |
| PTPN3 | NM_002829 | hCT1958113 | NRPTP | 6 (3%) colorectal cancers | | | | | |
| | | | | colorectal | Mx6 | G460A | V154I | KRAS | none |
| | | | | colorectal | Cx10 | C716T / G1828T | A239V / E610X | KRAS | none |
| | | | | colorectal | Co72 | T898G | S300A | BRAF | GUCY2F |
| | | | | colorectal | Hx35 | C921A | F307L | none | none |
| | | | | colorectal | Co95 | G989A | R330Q | ND | NTRK2 |

*Accession numbers for mutated phosphatases in GenBank and Celera. #Number of non-synonymous and splice site mutations observed and percent of tumors affected for each of the 6 genes in the panel of 175 colorectal cancers, 11 lung cancers, 11 breast cancers, and 12 gastric cancers. ‡Nucleotide and amino acid change resulting from mutation. When two mutations in the same gene in a tumor were observed, the mutations are separated by a slash. "X" refers to stop codon. "LOH" refers to cases wherein the wild-type allele was lost and only the mutant allele remained. "Splice site" refers to a case wherein the alteration affected position 1 of the acceptor splice site of exon 12 of PTPRF. "1159-1404substitution" refers to a case in PTPRF where the indicated region was substituted with an unrelated genomic sequence of the same size. Residues highlighted in blue are evolutionarily conserved. **Mutations previously observed in KRAS, BRAF or in members of the tyrosine kinase gene family are listed for each tumor analyzed (5, 6). "None" refers no mutation observed and "ND" refers to tumors not previously analyzed for mutations.

Fig. 6

Table S2. Tyrosine phosphatome genes analyzed

| Celera Accession | Genbank Accession | Gene Name | Gene Description | Family |
|---|---|---|---|---|
| hCT6668 | NM_032781.2 | PTPN5 | protein tyrosine phosphatase, non-receptor type 5 | PTP |
| hCT6451 | NM_015466.1 | PTPN23 | protein tyrosine phosphatase, non-receptor type 23 (HD-PTP) | PTP |
| hCT1950416 | NM_016364.2 | DUSP13 | dual specificity phosphatase 13 | DSP |
| hCT32908 | NM_021090.2 | MTMR3 | myotubularin related protein 3 | PTP |
| hCT32877 | NM_003479.2 | PTP4A2 | protein tyrosine phosphatase type IVA, member 2 | PTP |
| hCT18420 | NM_130391.1 | PTPRD | protein tyrosine phosphatase, receptor type, D | PTP |
| hCT1822830 | NM_177995.1 | PTP9Q22 | protein tyrosine phosphatase PTP9Q22 | PTP |
| hCT30485 | NM_000252.1 | MTM1 | myotubular myopathy 1 | PTP |
| hCT1951990 | NM_001395.1 | DUSP9 | dual specificity phosphatase 9 | DSP |
| hCT1815053 | NM_080876.2 | DUSP19 | dual specificity phosphatase 19 (DUSP19) | DSP |
| hCT32625 | NM_016086.2 | MK-STYX | map kinase phosphatase-like protein MK-STYX | DSP |
| hCT1982353 | NM_080683 | PTPN13 | protein tyrosine phosphatase, non-receptor type 13 (FAP1) | PTP |
| hCT32515 | NM_004417.2 | DUSP1 | dual specificity phosphatase 1 | DSP |
| hCT1644566 | XM_062330 | | similar to protein tyrosine phosphatase, receptor type, Q | PTP |
| hCT1644559 | XM_291741 | | similar to Dual specificity protein phosphatase 13 | DSP |
| hCT17069 | NM_002831.3 | PTPN6 | protein tyrosine phosphatase, non-receptor type 6 (SHP1) | PTP |
| hCT24042 | NM_003672.2 | CDC14A | CDC14 cell division cycle 14 homolog A | DSP |
| hCT1970499 | NM_080422.1 | PTPN2 | protein tyrosine phosphatase, non-receptor type 2 (TCPTP) | PTP |
| hCT1774420 | NM_033331.1 | CDC14B | CDC14 cell division cycle 14 homolog B | DSP |
| hCT16535 | NM_002849.2 | PTPRR | protein tyrosine phosphatase, receptor type, R | PTP |
| hCT1813266 | NM_004685.1 | MTMR6 | myotubularin related protein 6 | PTP |
| hCT28528 | NM_004418.2 | DUSP2 | dual specificity phosphatase 2 | DSP |
| hCT16333 | NM_002840 | PTPRF | protein tyrosine phosphatase, receptor type, F (LAR) | PTP |
| hCT9118 | NM_005670.2 | EPM2A | epilepsy, progressive myoclonus type 2A | DSP |
| hCT1955131 | NM_022648.2 | TNS | tensin | PTP |
| hCT28429 | NM_002828.2 | PTPN2 | protein tyrosine phosphatase, non-receptor type 2 | PTP |
| hCT1813194 | NM_030667.1 | PTPRO | protein tyrosine phosphatase, receptor type, O | PTP |
| hCT28364 | NM_002827.2 | PTPN1 | protein tyrosine phosphatase, non-receptor type 1 (PTP1b) | PTP |
| hCT16271 | NM_002837.2 | PTPRB | protein tyrosine phosphatase, receptor type, B | PTP |
| hCT1953979 | NM_133178.1 | PTPRU | protein tyrosine phosphatase, receptor type, U | PTP |
| hCT16153 | NM_007207.3 | DUSP10 | dual specificity phosphatase 10 | DSP |
| hCT1953703 | XM_294600 | | protein tyrosine phosphatase, receptor type, W (LOC347319) | PTP |
| hCT1768895 | NM_002833.2 | PTPN9 | protein tyrosine phosphatase, non-receptor type 9 (MEG2) | PTP |
| hCT11101 | NM_007039.2 | PTPN21 | protein tyrosine phosphatase, non-receptor type 21 (PTPH1) | PTP |
| hCT1797443 | NM_003463.2 | PTP4A1 | protein tyrosine phosphatase type IVA, member 1 | PTP |
| hCT14949 | NM_002841 | PTPRG | protein tyrosine phosphatase, receptor type, G | PTP |
| hCT14766 | AB033100 | | mRNA for KIAA1274 protein | PTP |
| hCT1951766 | NM_002838.2 | PTPRC | protein tyrosine phosphatase, receptor type, C (CD45) | PTP |
| hCT1951740 | NM_004419.2 | DUSP5 | dual specificity phosphatase 5 | DSP |
| hCT14606 | NM_002850.2 | PTPRS | protein tyrosine phosphatase, receptor type, S | PTP |
| hCT1816300 | NM_152511.2 | DUSP18 | dual specificity phosphatase 18 | DSP |
| hCT33988 | XM_037430 | DUSP7 | dual specificity phosphatase 7 | DSP |
| hCT1950123 | NM_007026.1 | DUSP14 | dual specificity phosphatase 14 | DSP |
| hCT14332 | NM_002843.2 | PTPRJ | protein tyrosine phosphatase, receptor type, J | PTP |
| hCT11067 | NM_002844.2 | PTPRK | protein tyrosine phosphatase, receptor type, K | PTP |
| hCT21458 | NM_004090.1 | DUSP3 | dual specificity phosphatase 3 | DSP |
| hCT1823204 | NM_004420.1 | DUSP8 | dual specificity phosphatase 8 | DSP |
| hCT30064 | NM_177991.1 | DUSP15 | dual specificity phosphatase-like 15 | DSP |
| hCT10729 | NM_002842.1 | PTPRH | protein tyrosine phosphatase, receptor type, H | PTP |
| hCT1640496 | NM_003828.1 | MTMR1 | myotubularin related protein 1 | PTP |
| hCT1961579 | NM_024025.1 | MGC1136 | hypothetical protein MGC1136 | DSP |
| hCT1645239 | NM_015605.2 | DKFZP566K0524 | DKFZP566K0524 protein | PTP |
| hCT1788024 | NM_022076.2 | DUSP21 | dual specificity phosphatase 21 | DSP |
| hCT1767727 | NM_015967.2 | PTPN22 | protein tyrosine phosphatase, non-receptor type 22 (LyP1) | PTP |
| hCT32220 | NM_130435.1 | PTPRE | protein tyrosine phosphatase, receptor type, E | PTP |
| hCT17735 | NM_001946.1 | DUSP6 | dual specificity phosphatase 6 | DSP |
| hCT1640270 | NM_004090.1 | DUSP3 | dual specificity phosphatase 3 | DSP |
| hCT30758 | NM_003584.1 | DUSP11 | dual specificity phosphatase 11 | DSP |
| hCT1640130 | XM_043754 | | hypothetical cardiac/skeletal muscle-expressed ORF | DSP |
| hCT31884 | NM_002835.2 | PTPN12 | protein tyrosine phosphatase, non-receptor type 12 (PTP-PEST) | PTP |
| hCT12542 | NM_016156.2 | MTMR2 | myotubularin related protein 2 | PTP |
| hCT24607 | NM_002851.1 | PTPRZ1 | protein tyrosine phosphatase, receptor-type, Z polypeptide 1 | PTP |
| hCT1696526 | NM_002845.2 | PTPRM | protein tyrosine phosphatase, receptor type, M | PTP |
| hCT12147 | NM_017657.2 | SSH-3 | slingshot 3 | DSP |
| hCT12099 | NM_002836.2 | PTPRA | protein tyrosine phosphatase, receptor type, A | PTP |
| hCT31320 | NM_001585.2 | C22orf1 | chromosome 22 open reading frame 1 | PTP |
| hCT1963526 | NM_017677.2 | MTMR8 | myotubularin related protein 8 | PTP |
| hCT1820965 | NM_002834.3 | PTPN11 | protein tyrosine phosphatase, non-receptor type 11 (Noonan syndrome 1) (SHP2) | PTP |
| hCT1766350 | NG_001337.1 | | T cell receptor beta variable orphans on chromosome 9 | PTP |
| hCT1805295 | NM_017823.2 | FLJ20442 | hypothetical protein FLJ20442 | PTP |
| hCT22967 | NM_002832.2 | PTPN7 | protein tyrosine phosphatase, non-receptor type 7 | PTP |
| hCT1964913 | NM_057158.2 | DUSP4 | dual specificity phosphatase 4 (Typ) | DSP |
| hCT1957126 | NM_002830.2 | PTPN4 | protein tyrosine phosphatase, non-receptor type 4 (MEG1) | PTP |
| hCT1955989 | NM_133170 | PTPRT | protein tyrosine phosphatase, receptor type, T | PTP |
| hCT20262 | NM_033389.1 | SSH2 | slingshot 2 | DSP |
| hCT6880 | NM_007240.1 | DUSP12 | dual specificity phosphatase 12 | DSP |
| hCT18896 | NM_017677.2 | MTMR8 | myotubularin related protein 8 | PTP |
| hCT6725 | NM_018984.1 | SSH1 | slingshot 1 | DSP |
| hCT1958113 | NM_002829.2 | PTPN3 | protein tyrosine phosphatase, non-receptor type 3 (PTPH1) | PTP |
| hCT6590 | NM_002846.2 | PTPRN | protein tyrosine phosphatase, receptor type, N | PTP |
| hCT9393 | NM_001789 | CDC25A | cell division cycle 25A | DSP |
| hCT2254822 | NM_022809 | CDC25C | cell division cycle 25C | DSP |
| hCT1951353 | NM_021874 | CDC25B | cell division cycle 25B | DSP |
| hCT2270543 | NM_014369 | PTPN18 | protein tyrosine phosphatase, non-receptor type 18 | PTP |
| hCT2261290 | NM_005401 | PTPN14 | protein tyrosine phosphatase, non-receptor type 14 | PTP |
| hCT2267768 | NM_007099 | ACP1 | acid phosphatase 1 | LMP |
| hCT1641130 | NM_145251.2 | STYX | serine/threonine/tyrosine interacting protein | DSP |

US 8,039,210 B2

PROTEIN TYROSINE PHOSPHATASE MUTATIONS IN CANCERS

This application is a national stage application of co-pending PCT application PCT/US2005/017105 filed May 16, 2005, which was published in the English under PCT Article 21(2) on December 1, which claims the benefit of provisional application Ser. No. 60/571,436 filed May 14, 2004, the disclosure of which is expressly incorporated herein.

This application incorporates a 502 KB text file named "seq1st00631" created Jul. 22, 2010, which is the sequence listing for this application.

This invention was made under contracts (CA43460 and CA63934) with an agency (National Institutes of Health) of the United States Government. The United States Government therefore retains certain rights in the invention.

TECHNICAL FIELD OF THE INVENTION

This invention is related to the area of cancer. In particular, it relates to diagnosis, prognosis, treatment, drug discovery, target discovery, clinical testing for cancer.

BACKGROUND OF THE INVENTION

Phosphorylation of tyrosine residues is a central feature of most cellular signaling pathways, including those affecting growth, differentiation, cell cycle regulation, apoptosis and invasion (1, 2). This phosphorylation is coordinately controlled by protein tyrosine kinases (PTKs) and phosphatases (PTPs). Although a variety of PTK genes have been directly linked to tumorigenesis through somatic activating mutations (3-6) only a few PTP genes have been implicated in cancer (7-10). Moreover, it is not known how many or how frequently members of the PTP gene family are altered in any particular cancer type.

The PTP gene superfamily is composed of three main families: (i) the classical PTPs, including the receptor PTPs (RPTPs) and the non-receptor PTPs (NRPTPs); (ii) the dual specificity phosphatases (DSPs), which can dephosphorylate serine and threonine in addition to tyrosine residues; and (iii) the low molecular weight phosphatases (LMPs) (1).

There is a continuing need in the art to identify new therapeutic targets, identify new drugs, improve diagnosis, prognosis, and therapy of cancers.

SUMMARY OF THE INVENTION

One aspect of the invention is a method for identifying mutations involved in cancer. Nucleotide sequence differences are determined in a human nucleotide sequence between matched pairs of cancer cells and normal cells. Each matched pair of cells is isolated from a single individual. The human nucleotide sequence encodes a protein tyrosine phosphatase selected from the group consisting of: PTPRF, PTPRG, PTPRT, PTPN3, PTPN13, and PTPN14.

Another aspect of the invention is a method of screening test substances for use as anti-cancer agents. A test substance is contacted with a wild-type form of a protein tyrosine phosphatase or a mutant form of a protein tyrosine phosphatase which is mutated in cancer cells. Activity of the form of the protein tyrosine phosphatase is tested. A test substance which increases the activity of the form of a protein tyrosine phosphatase is a potential anti-cancer agent. The protein tyrosine phosphatase is selected from the group consisting of: PTPRF, PTPRG, PTPRT, PTPN3, PTPN13, and PTPN14.

One embodiment of the invention provides an isolated, mutant form of a protein tyrosine phosphatase. The phosphatase is selected from the group consisting of: PTPRF, PTPRG, PTPRT, PTPN3, PTPN13, and PTPN14. Enzymatic activity of the mutant form is reduced compared to wild-type.

Another embodiment of the invention provides an isolated polynucleotide which encodes a mutant form of protein tyrosine phosphatase. The phosphatase is selected from the group consisting of: PTPRF, PTPRG, PTPRT, PTPN3, PTPN13, and PTPN14. Enzymatic activity of the mutant form is reduced compared to wild-type.

Still another aspect of the invention is a method of categorizing cancers. The coding sequence for or the amino acid sequence of one or more protein tyrosine phosphatase family members in a sample of a cancer tissue is determined. The family member is selected from the group consisting of PTPRF, PTPRG, PTPRT, PTPN3, PTPN13, and PTPN14.

A somatic mutation of the one or more protein tyrosine phosphatase family members is identified in the cancer tissue. The cancer tissue is assigned to a group based on the presence or absence of the somatic mutation.

According to another aspect of the invention a method of inhibiting growth of cancer cells is provided. A polynucleotide encoding a wild-type protein tyrosine phosphatase is administered to cancer cells. The phosphatase is selected from the group consisting of PTPRF, PTPRG, PTPRT, PTPN3, PTPN13, and PTPN14, Growth of the cancer cells is thereby inhibited.

Yet another aspect of the invention is a method of identifying cancer cells in a sample collected from a human. The coding sequence for or the amino acid sequence of one or more protein tyrosine phosphatase family members in a sample collected from the human is determined. The family member is selected from the group consisting of PTPRF, PTPRG, PTPRT, PTPN3, PTPN13, and PTPN14. The sample is selected from the group consisting of a suspected cancer tissue, blood, serum, plasma, and stool. A somatic mutation of said one or more protein tyrosine phosphatase family members is identified in the cancer tissue. The sample is identified as containing cancer cells if a somatic mutation is identified.

These and other embodiments which will be apparent to those of skill in the art upon reading the specification provide the art with reagents and methods for detection, diagnosis, therapy, and drug screening pertaining to cancers.

BRIEF DESCRIPTION OF THE DRAWINGS

(FIG. 2A) Saturation kinetics of wild-type and mutant PTPRT. His-tagged versions of PTPRT protein segments comprising the two catalytic domains containing wild-type (WT) and tumor-specific mutant sequences were expressed in bacteria and purified using nickel affinity chromatography. Equal amounts of WT and mutant proteins were used to evaluate enzyme kinetics. The rate of hydrolysis of substrate (DiFMUP) is plotted against increasing substrate concentration. Data were fitted to the Michaelis-Menton equation and the resulting kinetic parameters of WT and mutant proteins are indicated (FIG. 2B).

(FIG. 3A) HCT 116 colorectal cancer cells were transfected with wild-type (WT) PTPRT construct, truncated R632X mutant PTPRT construct, or empty pCI-Neo vector. The photographs show colonies stained with crystal violet after 14 days of geneticin selection. (FIG. 3B) Number of resistant colonies (mean of two 25 cm² flasks) for WT PTPRT, mutant PTPRT, and empty vector.

FIG. 5. (Table S1.) Mutations of the tyrosine phosphatome in human cancers

FIG. 6. (Table S2.) Tyrosine phosphatome genes analyzed (SEQ ID NO: 15-101; encoded amino acids SEQ ID NO: 102-187).

DETAILED DESCRIPTION OF THE INVENTION

Figure 1:
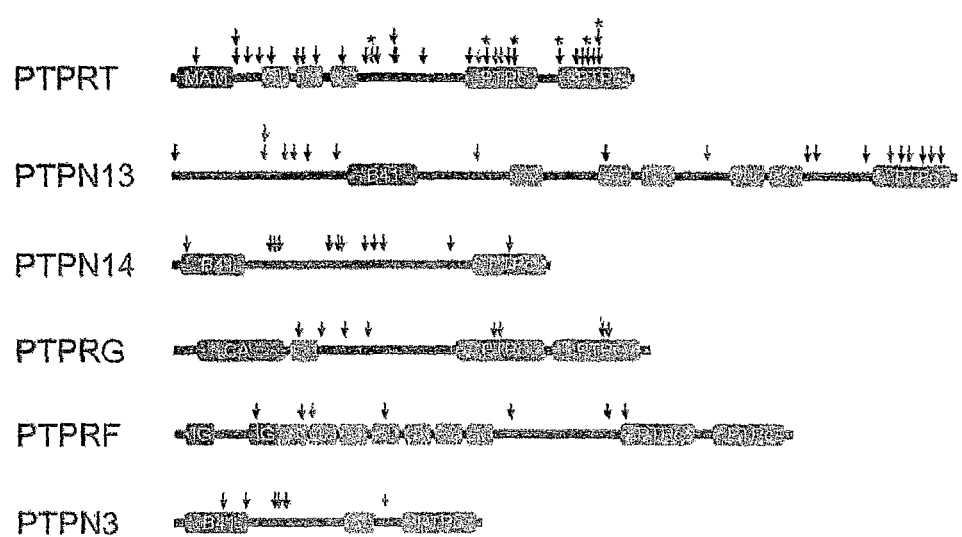
FIG. 1. Distribution of mutations in PTPRT, PTPN13, PTPN14, PTPRG, PTPRF, and PTPN3. Black arrows indicate location of missense mutations, red arrows indicate location of nonsense mutations or frameshifts, and boxes represent functional domains (B41, band 41; CA, carbonic anhydrase; FN3, fibronectin type III; IG, immunoglobulin; MAM, meprin/A5/PTPμ; PDZ, postsynaptic density, discs large, zonula occludans; PTPc, catalytic phosphatase domain). Black stars indicate PTPRT mutants evaluated for phosphatase activity (see results in FIG. 2), and red star indicates PTPRT mutant evaluated for effects on cell proliferation (see results in FIG. 3).

The inventors have discovered that protein tyrosine phosphatase genes are the targets of somatic mutations in cancers, suggesting that these genes function as tumor suppressors in human cells. 87 genes were identified as being members of the protein tyrosine phosphatase superfamily. These include members of the (i) the classical PTPs, (ii) the dual specificity phosphatases (DSPs), and (iii) the low molecular weight phosphatases (LMPs). See FIG. 6. Screening a collection of colorectal cancers identified six different genes of the classical PTPs which are the object of somatic mutations in the colorectal cancers. Some of these genes are also the subject of somatic mutations in breast, lung, and/or gastric cancers. Screening collections of other types of cancers will undoubtedly uncover other sets of the superfamily which are somatically mutated. Other types of cancers which can be screened for mutations include: bladder, melanoma, breast, non-Hodgkin's lymphoma, pancreatic, endometrial, prostate, kidney, skin, leukemia, thyroid, and lung.

Phosphatases which can be screened can be chosen from those shown in FIG. 6. Other phosphatases may be identified for screening, for example, using different bioinformatics criteria as described below. The primers identified below for amplification and sequencing of the phosphatases can be used, or other primers can be used as is convenient for the practitioner. For identification of mutations, determined sequences in samples can be compared to known sequences in the literature. For example, for each of the 87 phosphatases of FIG. 6, a GenBank and a Celera accession number are provided. Sequences determined in samples can be compared to the wild-type sequences provided in the databases and attached sequence listing. However, a better indication of involvement in cancer is provided by comparing a determined sequence to that in a normal tissue of the same human. Such a comparison indicates that a change is a somatic mutation. Sequences in databases refer to the sequences that existed in the databases as of May 14, 2004. GenBank stores and records sequences according to the dates on which they were indicated as the most recent update. Thus the sequences available on May 14, 2004 are maintained and publicly available.

See also the sequence listing. It is well recognized in the art that there is variation in the human population of wild-type protein and nucleic acid sequences. Such variation typically maintains sequences within a 95% identity range, more typically within a 97% identity range, and more typically within a 99% identity range.

Matched pairs of cells for determining somatic mutations ideally are cells from a single individual. Typically the cells are of the same type, e.g., lung cancer cells and normal lung cells. If a body sample such as blood or stool is being examined, then normal cells can be selected from any body tissue as a comparator.

Mutations that are relevant to cancer can be in almost any region of the phosphatases, because the relevant mutations are loss-of-function mutations. Thus the mutations can be in the catalytic domain or in other portions of the protein. Mutations can also be in non-coding, regulatory regions of the gene. Non-synonymous mutations change the encoded amino acids of a protein. Thus such mutations are highly likely to be functionally relevant to cancer. Mutations in residues that are evolutionarily conserved among species are also highly likely to be functionally relevant to cancer.

Since loss of protein tyrosine phosphatase activity appears to be detrimental to cells, reacquisition of activity should have a positive, therapeutic effect. Test substances can be tested for their ability to enhance the activity of PTPs by contacting a wild-type or mutant PTP with a test substance. The PTP can be isolated from cells and contacted in a cell-free system, or the PTP may be in cells, either genetically engineered host cells or native cells which express the PTP. The cells can be tested in culture or in a model non-human animal system. Typically the cells will be somatic cells. The PTP can be any mutant or wild-type form, especially one of the six PTPs identified as mutant in colorectal cancers, but also may any of the 87 identified below. One of the mutant forms identified in the present study can be used (see FIG. 5) or other mutant forms, for example those found in other types of cancer. PTPs can be isolated from producing host cells or native producer cells. One means of purifying a PTP is disclosed in example 7, in which a His tag is added to the PTP by cloning and then used to purify the PTP using nickel affinity beads. A desirable test substance for becoming a candidate anti-cancer agent will enhance the activity of a wild-type and/or mutant PTP or enhance PTP activity of a cell with wild-type, mutant, or both types of PTP.

Polynucleotides comprising coding sequences for PTPs, in particular mutant PTPs found in cancer cells, can be naturally occurring coding sequences or coding sequences which are synthesized based on the genetic code and the amino acid sequence of a mutant PTP. The coding sequences can be inserted in expression vectors so that quantities of the mutant PTPs can be produced efficiently and used in drug screening assays. Alternatively, host cells which contain expression vectors encoding mutant PTPs can be used for drug screening assays. The mutant PTPs may be reduced in enzyme activity, for example with a higher $K_m$ or with a lower $K_{cat}$ than wild-type. The mutant PTPs may alternatively have no detectable enzymatic activity.

Isolated polynucleotides are polynucleotides which are separated from the chromosome upon which they normally reside in the human genome. They are typically separated from the genes which flank them on a normal human chromosome. They may be in a vector with an origin of replication, or they may simply be an isolated linear piece of nucleic acid. The polynucleotides encoding PTPs may or may not contain the introns which are present in the human genome.

Cancer tissues can be categorized on the basis of which, if any, phosphatase mutation(s) they contain. Any of the PTPs demonstrated to harbor cancer-related mutations can be used for the categorization. Somatic mutations are identified on the basis of a difference between an affected tissue and a normal tissue of the same individual. Categorization of the tissue can be used for stratifying patients for clinical trials, for analyzing data from clinical trials, for correlating with prognostic data (such as recurrence, metastasis, and life expectancy), as well as for selecting an appropriate course of treatment for a cancer patient. The PTP categorization can be used in conjunction with other data, for example, histopathological data, to identify a cancer. Similarly, PTP somatic mutation analysis can be used in any tissue or body sample to diagnose cancer. Presence of a mutant PTP or coding sequence in a tissue or body sample indicates the presence of cancer cells, either in the sample itself, or in a tissue which drains into the sample. Thus, for example, detection of PTP mutants in a fecal sample reflects the presence of colorectal cancer cells in the human from whom the sample was taken. Body samples which can be tested include without limitation suspected cancerous tissues, stool, sputum, tears, saliva, blood, plasma, serum, urine, and bronchoalveolar lavage.

The mutational data associating loss of PTP function with cancers strongly suggests that PTPs are tumor suppressors. Therefore wild-type PTP coding sequences can be used as therapeutic agents for treating tumors. Wild-type PTP coding sequences are shown in the sequence listing. These sequences or wild-type sequences which are at least 95% identical, at least 96% identical, at least 97% identical, at least 98% identical, or least 99% identical, can be used to deliver wild-type PTP to tumor cells. The coding sequences may or may not contain introns. Sequences for any of the six PTPs identified as somatically mutated in colorectal cancers may be used, as well as any of the other PTPs identified in FIG. 6.

Viral or non-viral vectors may be used for delivery of polynucleotides. For example, adenoviruses, adeno-associated viruses, herpes viruses, and retroviruses can be used for delivery. Non-viral vectors include liposomes, nanoparticles and other polymeric particles. Any vectors or techniques known in the art may be used for delivering genes to cells or humans. See, e.g. *Gene Therapy Protocols*, Paul D. Robbins, ed., Human Press, Totowa, N.J., 1997. Vectors may not be necessary according to some protocols, and coding sequences can be administered without a means of replication. Administration of gene therapy vectors can be by any means known in the art, including but not limited to intravenous, intramuscular, intratumoral, intranasal, intrabronchial, and subcutaneous injections or administration. An effective amount of polynucleotide is one which inhibits growth of cancer cells in a measurable amount. Preferably the tumor regresses and shrinks, or at least ceases to grow larger.

The above disclosure generally describes the present invention. All references disclosed herein are expressly incorporated by reference. A more complete understanding can be obtained by reference to the following specific examples which are provided herein for purposes of illustration only, and are not intended to limit the scope of the invention.

Example 1

Identification of PTP Gene Superfamily Members

We employed a combination of Hidden Markov Models representing catalytic domains of members of the PTP superfamily to identify 53 classical PTPs (21 RPTPs and 32 NRPTPs), 33 DSPs, and one LMP in the human genome (12). This analysis revealed a set of genes representing all known human PTPs (13) as well as seven putative PTPs.

Example 2

Identification of PTP Gene Superfamily Members with Mutations

As an initial screen to evaluate whether these phosphatases are genetically altered in human cancer, we analyzed the coding exons of all 87 members of this gene family in 18 colorectal cancers. A total of 1375 exons from all annotated RPTPs, NRPTPs, DSPs and LMPs were extracted from genomic databases (12). These exons were PCR-amplified from cancer genomic DNA samples and directly sequenced using dye terminator chemistry (12). Whenever a presumptive mutation was identified, we attempted to determine whether it was somatically acquired (i.e., tumor specific) by examining the sequence of the gene in genomic DNA from normal tissue of the relevant patient.

From the 3.3 Mb of sequence information obtained, we identified six genes containing somatic mutations, including three members of the RPTP subfamily (PTPRF, PTPRG, and PTPRT) and three members of the NRPTP subfamily (PTPN3, PTPN13 and PTPN14). These six genes were then further analyzed for mutations in another 157 colorectal cancers. Through this strategy we identified 77 mutations in the six genes, in aggregate affecting 26% of the colorectal tumors analyzed (Table S1, FIG. 1). Examination of these six genes in seven other tumor types identified PTPRT mutations in two of 11 (18%) lung cancers and two of 12 gastric cancers (17%), and PTPRF mutations in one of 11 (9%) lung cancers and one of 11 (9%) breast cancers. No mutations were identified in 12 pancreatic cancers, 12 ovarian cancers, 12 medulloblastomas or 12 glioblastomas (FIG. 5 (Table S1), FIG. 1). In total, 83 nonsynonymous mutations were observed, all of which were somatic in the cancers that could be assessed (12).

Fifteen of the 83 mutations were nonsense, frameshift or splice site alterations, all of which were predicted to result in aberrant or truncated proteins. In 16 tumors both alleles of the phosphatase gene appeared to be mutated, a characteristic often associated with tumor suppressor genes. The majority of tumors with PTP gene mutations also contained mutations in KRAS or BRAF, and nine tumors contained alterations in previously reported tyrosine kinase genes (FIG. 5 (Table S1)). Thus the mutant phosphatases identified in this study are likely to operate through cellular pathways distinct from those associated with previously identified mutant kinases.

Example 3

Analysis of Mutation Types

Analysis of mutations in tumors is complicated by the fact that mutations can arise either as functional alterations affecting key genes underlying the neoplastic process or as non-functional "passenger" changes. The multiple waves of clonal expansion and selection that occur throughout tumorigenesis lead to fixation of any mutation that had previously occurred in any predecessor cell, regardless of whether the mutation was actually responsible for the clonal expansion. Two independent lines of evidence suggest that the sequence alterations we observed are functional. First, the ratio of nonsynonymous to synonymous mutations provides an indication of selection, as synonymous alterations usually do not exert a growth advantage. There were no somatic synonymous mutations detected in the colorectal cancers analyzed, resulting in a ratio of nonsynonymous to synonymous mutations of 77 to 0, much higher than the expected 2:1 ratio for non-selected passenger mutations ($p<1\times10-6$). Second, the prevalence of mutations in the coding regions of the analyzed genes was ~19 per Mb of tumor DNA, similar to the prevalence of functional somatic alterations observed in other gene families (e.g., the tyrosine kinome (6)) and significantly higher than the prevalence of nonfunctional alterations previously observed in the cancer genomes (~1 per Mb, p<0.01) (14). These data support the idea that these mutations were the targets of selection during tumorigenesis.

Example 4

Effect of Point Mutations on Enzymatic Activity

Figures 2A, 2B:
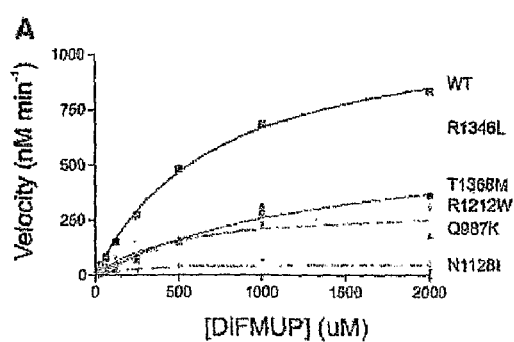
FIG. 2A-2B. Evaluation of phosphatase activity of mutant PTPRT.

The great majority of the nonsense and frameshift mutations (FIG. 1) would result in polypeptides devoid of C-terminal phosphatase catalytic domains, thereby leading to inactivation of the phosphatase. To evaluate whether tumor-specific point mutations alter phosphatase activity, we biochemically tested mutant versions of PTPRT, the most frequently mutated PTP in the superfamily. Mutations in both intracellular PTP domains (D1 and D2) were evaluated. His-tagged versions of the catalytic region of wild-type PTPRT, two D1 mutants (Q987K and N1128I), and three D2 mutants (R1212W, R1346L and T1368M) were produced in bacteria and analyzed for phosphatase activity using 6,8-difluoro-4-methylumbelliferyl phosphate (DiFMUP) as a substrate (FIG. 2) (12). All D1 and D2 mutants had reduced phosphatase activity compared with the wild-type protein (FIG. 2). Interestingly, the kinetic parameter $K_{cat}$ was reduced in both D1 mutants, while $K_m$ was increased in all three D2 mutants, suggesting that mutations in the two domains may have different effects on enzymatic activity. Although the D2 domain has been thought to usually be catalytically inactive (1), these results are consistent with recent studies that show that the D2 domain is important for phosphatase activity in some receptor phosphatases (15). These biochemical data on missense mutations, coupled with the large number of truncating mutations noted above, suggest that PTPRT functions as a tumor suppressor gene.

Example 5

Phosphatase Functions as Tumor Suppressor

Figure 3A:
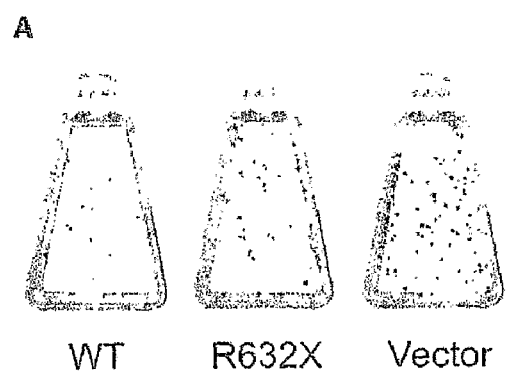
FIG. 3A-3B. PTPRT overexpression suppresses growth of human cancer cells.
Figure 3B:
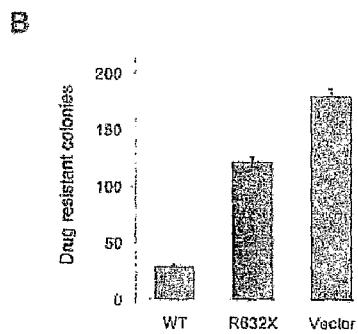

To determine whether PTPRT inhibits tumor cell growth, we transfected wild-type PTPRT into HCT116 colorectal cancer cells (12). An identical expression vector containing an R632X mutant of PTPRT was used for comparison. Wild-type PTPRT potently inhibited cell growth in this assay, as seen by the substantial decrease in the number of neomycin resistant colonies compared with the R632X mutant or with vector alone (FIG. 3A, 3B). Similar results with wild-type and mutant PTPRT were also observed in DLD1 colorectal cancer cells.

Example 6

Discussion

The combination of these genetic, biochemical, and cellular data suggest that PTPRT and the other identified phosphatases are likely to act as tumor suppressors. This is consistent with the function of other phosphatases implicated in tumorigenesis (7,8,16), and with the general role of phosphatases in inhibiting various growth promoting signaling pathways (2). The absence of biallelic mutations in a subset of the analyzed tumors suggests that some alterations may act in a dominant negative fashion or may affect gene dosage, mechanisms that have been previously involved in inactivation of other tumor suppressor genes (17, 18).

Figure 4:
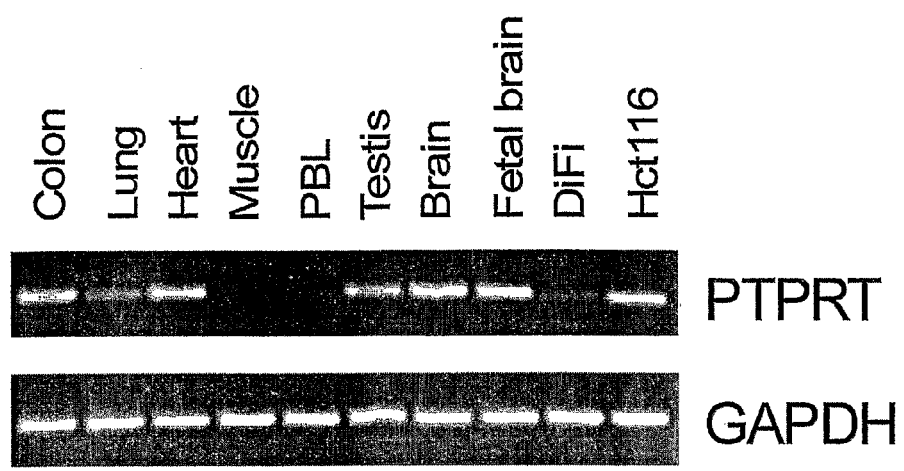
FIG. 4. Expression analysis of PTPRT. PTPRT expression was evaluated by reverse transcription of total RNA followed by PCR amplification using a forward primer from exon 31 and a reverse primer from exon 32. Expression analysis of glyceraldehyde-3-phosphate dehydrogenase (GAPDH) was performed as a control. Tissues analyzed are indicated above. PBL represents peripheral blood leukocytes; DiFi and Hct116 represent cancer cell lines derived from the colon.

Little is known about the functional role of the tyrosine phosphatases discussed here. PTPN13 appears to be involved in apoptosis (19) and may be partly responsible for the antitumor effects of tamoxifen (20). Overexpression of PTPN3 inhibits growth of NIH/3T3 cells, possibly through interaction with valosin containing protein (VCP/p97) (21). PTPN14 and PTPRF are thought to play a role in cell adhesion by regulating tyrosine phosphorylation of adherens junction proteins (22, 23). As increased phosphorylation of adherens junctions has been shown to increase cell motility and migration (22, 24), mutational inactivation of these genes may be an important step in cancer cell invasion and metastasis. PTPRG maps to chromosome 3p14.2, a region frequently lost in lung, renal and early stage breast tumors, and is thought to be a target of the translocation at 3p14 in familial renal cell carcinoma (25-27). However, no point mutations in PTPRG (28) or any of the other genes identified here have been previously described in any cancer. PTPRT is expressed in the developing central nervous system and in the adult cerebellum (29) and had not been thought to play a role in the growth or differentiation of other tissues. We have found that PTPRT is expressed in a variety of human tissues, including normal colon epithelium as well as cells derived from colorectal cancers (FIG. 4).

Example 7

Materials and Methods

Identification of PTP genes. Protein tyrosine phosphatase genes were identified by analysis of InterPro (IPR) phosphatase domains present within the Celera draft human genome sequence. IPR003595, IPR000340, IPR000751 and IPR002115 were used to search all known and predicted genes for classical PTPs (RPTPs and NRPTPs), DSPs, DSPs related to CDC25, and LMPs, respectively. This resulted in identification of 91 tyrosine phosphatases, three of which were pseudogenes and therefore not analyzed further. PTEN, which has been determined to act primarily as a lipid phosphatase was also not analyzed.

PCR, sequencing, and mutational analysis. Sequences for all available annotated exons and adjacent intronic sequences of identified PTP, DSP and LMP genes were extracted from Celera draft human genome sequence (website: celera.com) or from GenBank (website: genbank.nim.h.gov). Celera and public accession numbers of all analyzed genes are available in FIG. 6 (Table S2).

Primers for PCR amplification and sequencing were designed using the Primer 3 program (website: genome.wi.mit.edu/cgi-bin/primer/primer3_www.cgi), and were synthesized by MWG (High Point, N.C.) or IDT (Coralville, Iowa). PCR amplification and sequencing were performed on tumor DNA from 18 early passage cell lines as previously described (6) using a 384 capillary automated sequencing apparatus (Spectrumedix, State College, Pa.). Sequence traces were assembled and analyzed to identify potential genomic alterations using the Mutation Explorer software package (SoftGenetics, State College, Pa.). Of the 1375 exons extracted, 92% were successfully analyzed, each in an average of 17 tumor samples. All mutations listed in Table 51 were determined to be somatic except in 10 cases in which no normal tissue was available for comparison.

Construction of wild-type and mutant PTPRT proteins. The region encoding two catalytic domains of PTPRT was cloned by PCR using Platinum Hi-fidelity Taq polymerase (Invitrogen, Carlsbad, Calif.) from human fetal brain cDNA with primers GGAATTCCATATGGCCTTACCA-GAGGGGCAGACAG (SEQ ID NO: 1) and CGGGATC-CCCCAGTTACTGCCATTCACA (SEQ ID NO: 2) and cloned in frame fused to the 6×His tag of pET19b expression vector (Novagen, Madison, Wis.). The Q987K, N1128I, R1212W, R1346L and T1368M mutants were made using sexual PCR (Ref 30). The primers CAAAAGTCCTTTA-CAGTCTCCTTCATCGGACCTTGAGTCGCAATG (SEQ ID NO: 3) and AAGGAGACTGTAAAGGACTTTTGGAG (SEQ ID NO: 4) were used as mutagenic primers for the Q987K mutant; the primers CCATGCTTGACATGGC-CGAGATTGAAGGGGTGGTGGACATCTTC (SEQ ID NO: 5) and ATCTCGGCCATGTCAAGCATGG (SEQ ID NO:6) were used as mutagenic primers for the N1128I mutant; the primers CAATGCTGCAGTCCTCGGGCCA-CACACGGGGTGTCACAATG (SEQ ID NO: 7) and TGGCCCGAGGACTGCAGCATTG (SEQ ID NO: 8) were used as mutagenic primers for the R1212W mutant; the primers CTATACGATAACCATCCTGTGGCAGGGC-CATGTTACAGATGCG (SEQ ID NO: 9) and TGCCACAG-GATGGTTATCGTATAG (SEQ ID NO: 10) were used as mutagenic primers for the R1346L mutant; and the primers GAGCGCTTGGAGGGGGGCATGTCCCGG-TAGGCAGGCC (SEQ ID NO: 11) and TGCCCCCCTC-CAAGCGCTC (SEQ ID NO: 12) were used as mutagenic primers for the T1368M mutant. For expression of recombinant proteins, BL21-DE3 bacteria were grown to late log phase and induced with 1 mM IPTG for 3 hours at 37° C. Bacterial lysates were made by sonication in lysis buffer (1 mM Tris, 1 M NaCl, 10 mM imidazole 0.1% igepal, pH 8.0) and incubated with Ni-NTA beads for 45 min at 4° C. The Ni-NTA beads were washed with 50 mM imidazole buffer (40 mM Tris, 100 mM NaCl, 50 mM imidazole, pH8.0) and bound protein was eluted with 500 mM imidazole.

Phosphatase kinetic analysis. Various concentrations of 6,8-difluoro-4-methylumbelliferyl phosphate (DiFMUP-Molecular Probes D6567) were incubated with 800 ng of purified protein in 40 mM Tris-HCl pH8.0, 100 mM NaCl, 5 mM $CaCl_2$, and 10 mM DTT in a 100 uL reaction. The reaction was incubated at 37° C. for 30 minutes and fluorometric measurements were taken at an excitation wavelength of 360 nm and an emission wavelength of 460 nm and extrapolated to a standard curve of 6,8-difluoro-4-methylumbelliferone. The data were fitted to the Michaelis-Menton equation using GraphPad Prism v. 3.02.

Cell proliferation assays. Full length wild-type or R632X mutant PTPRT cDNA sequences were cloned into the pCI-Neo vector (Promega, Madison, Wis.). Subconfluent HCT116 and DLD1 colorectal cancer cells were transfected with equal amounts of the wild-type PTPRT construct, R632X mutant PTPRT construct, or empty vector and grown for 48 hours. Cells were then trypsinized and plated in T25 flasks with fresh media containing geneticin. Cells were grown for 2-3 weeks and stained with crystal violet. The expression level and the mutational status of PTPRT are not known in either HCT116 or DLD1 cells as no normal tissues from the same patients are available as controls.

Expression analysis. Total RNAs from various human tissues were purchased form BD Bioscience (San Jose, Calif.) and equal amounts were reverse transcribed into cDNAs with random primers. PTPRT expression was examined by PCR using primers CCACATCGTGAAAACACTGC (SEQ ID NO: 13) and CAACAGGAGACCCCTCAGAA (SEQ ID NO: 14) which are located in exons 31 and 32 and result in a 284 bp product.

REFERENCES

The disclosure of each reference cited is expressly incorporated herein.
1. B. G. Neel, N. K. Tonks, *Curr. Opin. Cell Biol.* 9, 193 (1997).
2. T. Hunter, Philos. *Trans. R. Soc. Lond. B. Biol. Sci.* 353, 583 (1998).
3. P. Blume-Jensen, T. Hunter, *Nature* 411, 355 (2001).
4. H. Davies et al., *Nature* 417, 949 (2002).
5. H. Rajagopalan et al., *Nature* 418, 934 (2002).
6. A. Bardelli et al., *Science* 300, 949 (2003).
7. J. Li et al., *Science* 275, 1943 (1997).
8. P. A. Steck et al., *Nat. Genet* 15, 356 (1997).
9. M. Tartaglia et al., *Nat. Genet* 34, 148 (2003).
10. S. Saha et al., *Science* 294, 1343 (2001).
11. A. R. Forrest et al., *Genome Res.* 13, 1443 (2003).
12. Materials and Methods are available as Supporting Online Material.
13. J. N. Andersen et al., *Mol. Cell. Biol.* 21, 7117 (2001).
14. T. L. Wang et al., *Proc. Natl. Acad. Sci. USA* 99, 3076 (2002).
15. A. Organesian et al., *Proc. Natl. Acad. Sci. USA* 100, 7563 (2003)
16. S. S. Wang et al., *Science* 282, 284 (1998).
17. S. E. Kern et al., *Science* 256, 827 (1992).
18. R. Fodde, R. Smits, *Science* 298, 761 (2002).
19. G. Bompard, C. Puech, C. Prebois, F. Vignon, G. Freiss, *J. Biol. Chem.* 277, 47861 (2002).
20. G. Freiss, C. Puech, F. Vignon, *Mol. Endocrinol.* 12, 568 (1998).
21. S. H. Zhang, J. Liu, R. Kobayashi, N. K. Tonks, *J. Biol. Chem.* 274, 17806 (1999).
22. C. Wadham, J. R. Gamble, M. A. Vadas, Y. Khew-Goodall, *Mol. Biol. Cell.* 14, 2520 (2003).
23. T. Muller, A. Choidas, E. Reichmann, A. Ullrich, *J. Biol. Chem.* 274, 10173 (1999).
24. O. Ayalon, B. Geiger, *J. Cell. Sci.* 110, 547 (1997).
25. S. LaForgia et al., *Proc. Natl. Acad. Sci. USA* 88, 5036 (1991).
26. I. Panagopoulos et al., *Cancer Res.* 56, 4871 (1996).
27. K. Kastury et al., *Genomics* 32, 225 (1996).
28. T. Druck et al., *Cancer Res.* 55, 5348 (1995).
29. P. E. McAndrew et al., *J. Comp. Neurol.* 391, 444 (1998).
30. R. Higuchi, B. Krummel, R. K. Saiki, *Nucleic Acids Res.* 16, 7351 (1988).

SEQUENCE LISTING (187 sequences)

SEQ ID NO: 1 - DNA, 35 bp, Homo sapiens
ggaattccatatggccttaccagaggggcagacag

SEQ ID NO: 2 - DNA, 28 bp, Homo sapiens
cgggatcccccagttactgccattcaca

SEQ ID NO: 3 - DNA, 45 bp, Homo sapiens
caaaagtcctttacagtctccttcatcggaccttgagtcgcaatg

SEQ ID NO: 4 - DNA, 26 bp, Homo sapiens
aaggagactgtaaaggacttttggag

SEQ ID NO: 5 - DNA, 44 bp, Homo sapiens
ccatgcttgacatggccgagattgaaggggtggtggacatcttc

SEQ ID NO: 6 - DNA, 22 bp, Homo sapiens
atctcggccatgtcaagcatgg

SEQ ID NO: 7 - DNA, 41 bp, Homo sapiens
caatgctgcagtcctcgggccacacacggggtgtcacaatg

SEQ ID NO: 8 - DNA, 22 bp, Homo sapiens
tggcccgaggactgcagcattg

SEQ ID NO: 9 - DNA, 43 bp, Homo sapiens
ctatacgataaccatcctgtggcagggccatgttacagatgcg

SEQ ID NO: 10 - DNA, 24 bp, Homo sapiens
tgccacaggatggttatcgtatag

SEQ ID NO: 11 - DNA, 37 bp, Homo sapiens
gagcgcttggaggggggcatgtcccggtaggcaggcc

SEQ ID NO: 12 - DNA, 19 bp, Homo sapiens
tgcccccctccaagcgctc

SEQ ID NO: 13 - DNA, 20 bp, Homo sapiens
ccacatcgtgaaaacactgc

SEQ ID NO: 14 - DNA, 20 bp, Homo sapiens
caacaggagacccctcagaa

SEQ ID NO: 15 - DNA, 2965 bp, Homo sapiens
gcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctccggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccgcagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtagtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 16 - DNA, 5248 bp, Homo sapiens
acgcgtccggcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacactcttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccggcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccaccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtggcccgtaaaaaaaaaaaaaaaaaaaa

SEQ ID NO: 17 - DNA, 1053 bp, Homo sapiens
ggggatcctggagctggaggagctcctgcgggcagggaagtcttcttgcagccgtgtggacgaagtttggcccaaccttttcataggagatgcaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggatgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcgcaaaaaaaaaaaaaaaaaaaaaaaaaaaaaa

SEQ ID NO: 18 - DNA, 5963 bp, Homo sapiens
gtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaa

SEQ ID NO: 19 - DNA, 3925 bp, Homo sapiens
agcggggctgcgcgaagtcatcgctgttccagacagcgatgactcgagagcggtgggggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggcttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaatatttccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattaggcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtattgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctcaaaaaaaaaaaaaaaaaaaaaaaaaaaaaaaaaaaaaaaaaaaaaaaaaaaaaaaaaaaaaaaaaaa

SEQ ID NO: 20 - DNA, 6224 bp, Homo sapiens
gctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattctttgacatcgccccttcccaccatactgctcataataacattttaggggccaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagtt

SEQ ID NO: 21 - DNA, 4515 bp, Homo sapiens
gggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccat

SEQ ID NO: 22 - DNA, 3411 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatatggggggggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctcccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacct

SEQ ID NO: 23 - DNA, 2303 bp, Homo sapiens
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaagcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagataaaaaaaaaaaaaaaaaaa

SEQ ID NO: 24 - DNA, 5183 bp, Homo sapiens
agcggggtgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataaggtgactcatattcttaatgttgcatatggagttgaaaatgctttcctcagtgactttacatataagagcatttctatattggatctgcctgaaaccaacatcctgtcttattttccagaatgttttgaatttattgaagaagcaaaaagaaaagatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaactcccttttttctcttgccttttttatgcataaatggaggtcaatctgattgtcctgacctactgtataagtaaatttcaaatgtcattactttctctttgttattataatgtgtgattaaatgcttttttaaattgctaagggaaaataacaaagtgttagtaatcattgctttctgtagaagaaaaaggtttaaatttaaaatgtgtatttagagcatggagagaatcatttaatgaagcctatttttctgttccagcaactgtttttatgaaagaaaaacttgaaatgctacttaacttactatttcaaagggaagtatatttctttttaaagaatctttttaagattaaaaatgaataccttaaatctcccaaaagagataaccagtatctgaaggtttatacaatatttacacagtggctacaatattcacaaaattcttatgttctcttatgaaaaatatacacttttcattttgtcttcttcttttttttttttttttagatggagtttggctcttgtcacccaggctggagtgcagtggcgcaatctcggctcactgcagcctctgcctcccgggttcaagcgattctcctgctccagcctcccatatagctgggattataggtgcctgccaccatgcccggctaatttttgtgttttttagtagagatggagtctcaccacataggccaggcagtctcgaactcctgacctcaggtgatccacccaccttggcctctctaaatgctgggattgcaggcgtgagccactgcatccgacctcattttgtttttttcaattctgttatcggcatttctttctttttttttttaatgtataggtgttctgtcatacgttattgtgagctttggttctttgaacaggtgatctattctcttacattttgtgctttttatcttgggtgcctagcattctgtttttttgatcctatgtcataattttttgagaaaatgtttgatactgcaagatcattgtttagtggtctgttttctacttcagtattctaccagagaacatattttttaggggagaagggttatggttttgtaagaaactttaaatatacttttaggagacccacaatcatttacagttttatctttggcctttgaataggttcttttttctttaatgtctccgtatttgcagaactgagctctgtacgttataaatttgcttaaagattttgattttttcttcagaatatggtatacttaaaattaattaattaagacagtttcttttttcttttctttttttttttttcgagacagggtcttgctctgtcacctaggctagagtggagtggcatgaacacaacgcactgcagcctctacctcctgggctcaagcagtcctcccacctcagtctcctgagtagctgagactacagctgtgcgccaccacatctggctaattttatttttatttttgtagagacaggagtcttgccatgttgcccaggctgatctcaaactcctaggcttaagtgatcctcccgccttagcctcccaagtgctaggattacaggcatcagccaccacgcctggcctgatagtttccacatagtttttcatgacttagaagatatcattgccatgtaggttttatttttaaaagtcttgagctcttcttaaatatacattataaagagcaagcatagatggaaagtgcatattgaacacatctgtgcatttgagaaggcaggctttcatatgctgtcatgagcaaaaagtagaagtgataaatgcaagttatgttttgagattgcttacaccgtgacaagatgccatcacttgtgatgttatgaactgttataaactctttgcttctgctaagaagcagtctaaatataatcaacgtacagtgagctctttgaagccaaccaaggcaggcagaaccctcttaaatatgagactgatgtataggttctctctatggtcagtatcactggataagccttctcctttcataagaaaggatgtatttaaatacattttattttgctaaatcctgtttagttttcagccattaaatgtcacatgaagccttgatagaatttgttcataatggctcatgtattattattatttttgagatggagttttgctcttaatgatattattattatttgagacagagttttgctcttattgcccaggctggagtgcagtggcgtgatcttggctcactgcggcctctgcctcccggcttcaagcgattctcctgtatcggcctcccaggtagctgggattataggcgtgtgccaccatgcccagcaaattttgtatttttttttggtagagacagggttcaaccgtgttggtcaggctggtctcgaactcctgaccgcaagtgatccacacgccttggtctcccaaagtgctgggattacggtgttagccactacacctggcctggattgtgtattatttatgtctgtagtttatatgcttagttgttgcctatagtgatctgggtaagattcaaacatttatcttttgtatcttctacagaagtgctttgagcatcaaatttgttttaacgttaaattgtagtttgctgtattaaaatagatcaatgaatataattcagtcttttaggggcaccaagtaaagcataaggtcatatatactatacaatatgtttattgcacttcccatggggataaatcactctgtcattcctagttattttaaaaaaagaactttatgattacggtcctctttctcacatactgcaaacttaaaagatacatacaccaaatataggtctgttttaaaggagaggaaaaatagttcaaggagtttttgcctctttgtttttaaatagattattctgccattttttaaaggaaagggaaaatgaaaacagcatgtctttttaaacattgaaaagaaatatggaggctttaaaccgcaaactgaaaaagctgagtagaacaaaggcagtggagcatacaatacaattctatttatttgaggttaattgaagttaataatttttaaatttttttctaattttatgccttaaaataggtttctgattacataaaatttgaatagaacactcaagaagtatgtagatttttgaaaaacccaaacaatattcttcttagatttttggaggcaaaatttagaccagtatactaattcaaaagacaaatatttcagaggaagtggagtatagtatttaacattttgtttgcaattttactttttcttcccttcttccctattgaaccttgattaaaatgtatgaatacaatacttggatttttttttcagcttagactctgataatttcagtggtagtggggaaacctgaatttgtcagcatgattatttgtaactcagattgttcaaatgtatatagaaggtccccttcaagtgttgtttctccaagtagtcataaatgtagcaagtataaatcagaatatcatcttataatcttacagagttaacctaatgagtcaatacctttataagcaaaaccatgataaatttaaaaacaacagaaatgtggcatgattacttatttatttgttccaggtgactctaaatagttgatttttctgcctgaaggatcctgaacatatttagttaccctgtagttatttaggaatttaaaccagaagactttgaagttgtatattcttgcaatgcataaaatgacattataatcaacaaacttatggtttgtttcaattgatgcacacaaaaaataacttatagttagacttttctatttcaagtaaagctttgagttacttatttttatacatattcatcatgtaccctttattgtttctaggtgttgatatactttaataaaaatgatatgtttaatattttcccattaatatatttctttgaagctatttgttttaaaagatgtaacacttatttgctgtcaaattctgaattaaaaaatctgttggtggccgggcgcagtggctcatgcctgtggtcccaacattttgggaggccaaggagatggatcacttgaggccaggagttcgagaccagcctggccaacatggcaaaaccccatcactaaaaatacaaaaattacccgggcatggtggtgggtgcctgtaatcccagcttcttaggaggctgaggtaggagaattgcttgaccctgggaggtggaggtggcagtgagccgagatagcaccactgcacttctagttgacagagtgagactctgactcaaaaaaaaaaaaaaaa

SEQ ID NO: 25 - DNA, 1429 bp, Homo sapiens
gccacttccgggagtcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctcatgttaaaaaaaaaaaaaa

SEQ ID NO: 26 - DNA, 8119 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 27 - DNA, 2015 bp, Homo sapiens
tcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattg

SEQ ID NO: 28 - DNA, 597 bp, Homo sapiens
atgtcagacagaaaagatgtagctgtgtatccatgtctgtttctgtgtatcggatgggttgctgctgaaaacagtgctggcattggagtgtttagtgatccatttctcttccaaactgcagaaagtgctccaggaaaagtggtgaatctcacagttgaggcctacaacgcttcagcagttaagctgatttggtatttacctcggcaaccaaatggcaaaattaccagcttcaagattagtgtcaagcatgccagaagtgggatagtagtgaaagatgtctcaatcagagtagaggacattttgactgggaaattgccagaatgcaatgagaatagtgaatcttttttatggagtacagccagcccttctccaacccttggtagagttacacctccatcgcgtaccacacattcatcaagcacgttgacacagaatgagatcagctctgtgtggaaagagcctatcagttttgtagtgacacacttgagaccttatacaacatatctttttgaagtttcagctgctacaactgaagcaggttatattgatagtacgattgtcagaacaccagaatcaggtatggttcactttttgtag

SEQ ID NO: 29 - DNA, 741 bp, Homo sapiens
atgacatctggagaagtgaagacaagcctcaagaatgcctactcatctgccaagaggctgtcgccgaagatggaggaggaaggggaggaggaggactactgcacccctggagcctttgagctggagcggctcttctggaagggcagtccccagtacacccacgtcaacgaggtctggcccaagctctacattggcgatgaggcgacggcgctggaccgctataggctgcagaaggcggggttcacgcacgtgctgaacgcggcccacggccgctggaacgtggacactgggcccgactactaccgcgacatggacatccagtaccacggcgtggaggccgacgacctgcccaccttcgacctcagtgtcttcttctacccggcggcagccttcatcgacagagcgctaagcgacgaccacagccggaagcgggatgtgcgcgtgcgaaatctttgtcgcaaagctgggccactggggctgcttgtggccgagggtaaaggtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacggtgaggaggaggatggcagggagctgtag

SEQ ID NO: 30 - DNA, 2253 bp, Homo sapiens
gccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtgaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 4262 bp, Homo sapiens
cgaagaggatccggagcagctgctgccagcccgcgggcactgaagtcctcccggctgccgctcgagtagccacgggcgcgatcgggaccagaagtctcctcctccatgatcactttggaagccgggggggaagactttgccctgccctgagagctggtctgcgtttcccaggcgcggcggcggcggagcagcagctgcagcagccgagtccaaataggagcggccacagccaggggcgtgtgcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaacttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaatttaaaaaaaaaaaaaaaaaa

SEQ ID NO: 32 - DNA, 1714 bp, Homo sapiens
gctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtatttttatactttttggcagcattaaatatttttgttaaataaaaaaaaaaaaaaa

SEQ ID NO: 33 - DNA, 4624 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgccaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccgg

SEQ ID NO: 34 - DNA, 3492 bp, Homo sapiens
cagctaagacccggagaggtggaatttcactttgaaattcccttgcctcgtgagggccggcgctgggcatgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagccaaaaaaaattaaaataactaccctcagcaaacactagctgttctgctcatatatgaatttttaatgcagcaatgttgactttgtttcatactgccaataaactcttaatact

SEQ ID NO: 35 - DNA, 1866 bp, Homo sapiens
atggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgtcggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcccaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcagtttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttag

SEQ ID NO: 36 - DNA, 1702 bp, Homo sapiens
ggagtcgaccgctcgggcagcgcaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctccggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacacttcctcccccgcttcctcctagccctgtgggcaggggttggaaacttagcactttatatttatacagaacattcaggatttgtcaataaaatattgttatatttaaaaaaaaaaaaaaaaaaaaaaaaaaa

SEQ ID NO: 37 - DNA, 7718 bp, Homo sapiens
cgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcccacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgtgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgttttttttttttttttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaaaaaaaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaaaaaaaaaaa

SEQ ID NO: 38 - DNA, 3487 bp, Homo sapiens
gagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctggcggctccgctgaccccttcccgccggcctggacgaagtctgggcttgggagccgcgtgatgcatcccaaagaaggcgcagaacagcacgtgttctccccggtgcccggggctcccacaccaccgcccaatcgctgcggccgcctagtgctcgggccgcgcctgccagccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggcgctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactggacacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggcttgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgccgtgagctggtcaagttgccaaaggaggaaataaggttagaagcctgaaccgtacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagacaaaaaaaaagaaaaaaaaaa

SEQ ID NO: 39 - DNA, 7267 bp, Homo sapiens
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcatggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggcggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagcgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaaaaaaaaaaaa

SEQ ID NO: 40 - DNA, 2477 bp, Homo sapiens
gctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggagactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaaaaaattgtatgtcgattgaattgtactggatacattttccatttttctaaaaagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaaccttaaaaaa

SEQ ID NO: 41 - DNA, 5153 bp, Homo sapiens
gggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtggct

SEQ ID NO: 42 - DNA, 3318 bp, Homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 43 - DNA, 6331 bp, Homo sapiens
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaagattatttctctggatgaagagagaactgtggtcttgcaaacagatcctttacctcctgctaggtttggagtcagtaaagagaagacgacttcaaccggcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgtcccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcttaggtggaaaacgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgaccattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtaaa

SEQ ID NO: 44 - DNA, 5607 bp, Homo sapiens
aattccgggcgccagtcccgctccgcgccgcgccgctccgctccggctcgggctccggctcgcctcgggctgggctcgggctccgggggcggcgtccccgccgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacaggccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccatgcgccaacgcttcctcttgcaacggcagagcggggccctggtgccggcggcgggcgttcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagcgaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccaaaaaaaaaaaaaaaaaaaaaa

SEQ ID NO: 45 - DNA, 2619 bp, Homo sapiens
ttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 46 - DNA, 1708 bp, Homo sapiens
gcagaactatgaggccaagagtgctcatgcgcaccaggctttctttttgaaattcgaggaaaggaggcatggcagagggctagggcttggcatgggagcagggggcttcatgtgcccaaccctgaatgcacagctttcactctctgcagatgaccactccagggtcaggctgacccagctggagggagagcctcattctgactacatcaatgccaacttggtcccaggctacacccgcccacaggagttcattgcctctcaggggcctctcaagaaaacactggagaacttctggcggctggtgcgggagcagcaggtccgcatcatcatcatgccgaccatcagcatggagaacgggagggtgctgtgtgagcattactggctgaccgactctaccccggacacccatggtcacatcaccatccacctcctagctgaggagcctgaggatgagtggaccaagcgggaattccagctgcagcacgctcccagctccctgctcgcctttatggagctgctcctcaggggctgtccctgcggtgtgggcatgggccggacaggcaccttcgtggccctgtcgaggctgctgcagcagctggaggaggagcagatggtagacgtgttccatgctgtgtatgcactccggatgcaccagcccctcatgatccagaccctgggcctgaaaaatctccctgcaggcccccctcgctcctcgctgagcagcctgatgccttttcccctggcagagccagcaggctccctgctcctgttcgtgggcagagctgagcggactagaacggggagctggggaaccttgagtgccttctccctctccaacccccccaccaggtcttggcccatctctgtgacggacctcccgcaggcgtgtgccaagagggcagccagtgccaatgctggcttcttgaaggagtacgaggccatcaaggacgaggctggcttttccgcacccccgcctggctatgagcaggacagccccgtctcctatgaccgttctcaggggcagttttctccggtggaggagagcccccctgacgacatgcccgaagcctggctcttccctggtgggccctctggccgtgatcatacggtgctgactggccccgcagggccaaaggagctctgggagctggtgtggcagcacagggctcatgtgcttgtctctctttgcccacccaatgtcatggagaaggaattctggccaacggagatgcagcccgtagtcacagacatggtgacggtgcactgggtggctgagagcagcacagcaggctggttctgtaccctcctcagggtcacacatggggagagcaggaaggaaagggaggtgcagagactgcaatttccatacctggagcctgggcatgagctgcccgccaccaccctgctgcccttcctggctgctgtgggccagtgctgctctcggggcaacaacaagaagccgggcacactgctcagccactccaagtgttgttggacaatggtcagttgcagcaagggtgcaacccagctgggcaccttcctggccatggagcagctgctgcagcaggcagggtctgagtgcaccgtggatatctttaacgtggccctgcagcagtctcaggcctgtggccttatgaccccaacactgaagcagtatgtctacctctacaactgtctgaacagcgcgctggcagacgggctgccctga

SEQ ID NO: 47 - DNA, 3956 bp, Homo sapiens
ggctgaggcagccgcgcaggtcgcagggccagcgtccgcgaggacggcccggctgggcggccccgagctctgtggcgctgtggaggagcgggagcgcggccgagaaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaaccaaaaaaaaaaaaaaaaaa

SEQ ID NO: 48 - DNA, 4234 bp, Homo sapiens
gcccatgagcgcgccgcggcccgggctggcgtgcgggtgcggctgcggcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacttcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccccctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgcgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttaccgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaaaaaaaaaaaa

SEQ ID NO: 49 - DNA, 4394 bp, Homo sapiens
ccggctcggtacgcgctctgctccgagccgctcactgcgtggtagagtctggtgcccccgccgtcgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattattttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcacatctaatattttatatgccttttggagctgtgtaagttaatatttgatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgctttaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggttaaaaaaaaaaaaaaaaaa

SEQ ID NO: 50 - DNA, 5787 bp, Homo sapiens
atgttacttcctgtatggaggcatggccagtttccagcgccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgtctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggagccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaaggcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcccagtaaaaaaaaaaaaaaaaa

SEQ ID NO: 51 - DNA, 4569 bp, Homo sapiens
cggacgcgtgggcaggtcccgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtctggggtcctgaggctgctggcagactatgggtacaacggccagcacagcccagcagacggtctcggcaggcaccccatttgagggcctacagggcagtggcacgatggacagtcggcactccgtcagcatccactccttccagagcactagcttgcataacagcaaggccaagtccatcatccccaacaaggtggcccctgttgtgatcacgtacaactgcaaggaggagttccagatccatgatgagctgctcaaggctcattacacgttgggccggctctcggacaacacccctgagcactacctggtgcaaggccgctacttcctggtgcgggatgtcactgagaagatggatgtgctgggcaccgtgggaagctgtggggcccccaacttccggcaggtgcagggtgggctcactgtgttcggcatgggacagcccagcctcttagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaggaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttcttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccagcaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtg

SEQ ID NO: 52 - DNA, 5026 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 53 - DNA, 2473 bp, Homo sapiens
aatcgcgaaacccggcgagcggcgcgctggctatcgagcgagcggggcggaaccgggagttgcgccgccgctcgggcgccgggctccgtcgcggccgcagccccgcgggtcgccctcccgtgcctcgcccgcggacaccctggccgtggacaccctggccgtgggcacccgcggggcgcggcgcgggcgctgcgcggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacttgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataagccaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaactgtggacttctgggatttgcagattttgcaacgtggtactacttttttttctttttgtctgttagttatttctccaggggaaaaggcaataattttctaagacccgtgtgaatgtgaagaaaagcagtatgttactggttgttgttgttgttcttgttttttatatgtaaaataaaaatagtgaaaggag

SEQ ID NO: 54 - DNA, 6500 bp, Homo sapiens
attccatcccatcaccccatgatccttccccattgtcccatgaacagcccctgcaggaccctcccctgctccatgtgaccctccctctgcctcctccatgaaggtctcctggatttccccactcgcctctcacagccctccattgtctctgcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggcgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcacggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 55 - DNA, 2464 bp, Homo sapiens
acatgcgcacagagcccgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatggcagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactgaccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtcttcttttgaaactgtcctgctctgtcacccatcctggagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcgggccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgcgcttagcgcaaatggcagctctcatcatgaatgatagactctttcaccctgctggtcccaggtcggcacacacatcctcataatggcatttctcctttctgtgcacagcactttattgttacaaagtactcttccaaaaagttaccctgtgtgtaaaaaaaaaaa

SEQ ID NO: 56 - DNA, 1945 bp, Homo sapiens
cgcggtgcgcgcggagggccgggcgggcgggcgggacggaggccgggaggccgggaggccggggcggcgggcgcgcagctcggcgggaggcgggcgcccggagacgcggctggggcccgcgcggccggggcgccgtcccagggcagggctgcccggccccggccccgggccgcccgcgctccccatgaaaaaccagctccgcggccccccagcgcgggcgcacatgtcgacttcgggggcggcggcggctgggggcacccgggcggggtccgagcccggtgcggggtcggggtccggcgcaggcaccggggcgggcgcggcgacgggggcaggggccatgccctgcaagagcgccgagtggctgcaggaggagctggaggcgcgcggcggcgcgtccttgctgctgctcgactgccggccgcacgagctcttcgagtcgtcgcacatcgagacggccatcaacctggccatcccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattgacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagctcttcttgatttttcttttttttttttttttttaacaaaaagtgttattttcaggctacatgcaacagtggattgtataacccagtatttcatccctttcctgatcc

SEQ ID NO: 57 - DNA, 1471 bp, Homo sapiens
gtggccgcgcaggaggacggagccctaaccgcaacccgcgccgcgccgcgccgatttgatttgtatccactgtcaccagcactgctcacttaggactttctggatccagacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcatacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaaaaaaaaaaaaaaaaaaa

SEQ ID NO: 58 - DNA, 5119 bp, Homo sapiens
ccccagccgcatgacgcgcggaggaggcagcgggacgagcgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgacgatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaaacctaaaaaatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcacttttttttttttcccccttgaggattgcggaaaaccaggaaaagggatctatgatttttttttccaaaacaatttcttttttaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccggccccgcttcccctgcccccgtgtgatttgtgctccattttttcttcccttttccctcccagttttc

SEQ ID NO: 59 - DNA, 5982 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatctttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattat

SEQ ID NO: 60 - DNA, 861 bp, Homo sapiens
gccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggaaaggtgtccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgt

SEQ ID NO: 61 - DNA, 2377 bp, Homo sapiens
ggggagccgaggcgagcgcgagcgaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcacgctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgcttgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggccctcccagttcccccgccccaggaaacactgctgacctttgcaaaggctgccgagctttcgtgcactttttacataacaaaaaggg

SEQ ID NO: 62 - DNA, 1184 bp, Homo sapiens
cgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 63 - DNA, 3900 bp, Homo sapiens
ctaggcctgggactcctgggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacagctcacaacccagtgaggaaacctgagagtggaggctcagaccaccagctccatctccctgagctgggaggtccccgatggcacagacccacagaactcgacctactgcgtacgagtgcactggagatggtggcagaacagagactcgaaacacaacagacaccagagtcaccagtggatggccttggacccgggtcattgtatacgtgttctgtgtgggtggagaaagacggagtaaatagctcctcgtggagattggtaactagtaccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagggtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccag

SEQ ID NO: 64 - DNA, 2754 bp, Homo sapiens
agcgggggggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgt

SEQ ID NO: 65 - DNA, 1665 bp, Homo sapiens
gttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaaaaaaaaaaaaaaaaaa

SEQ ID NO: 66 - DNA, 2494 bp, Homo sapiens
ggtcccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctggtacgcgcaaaattgtttctgaaggagaactagatcagttggctcagattcggccattaatattcaattttcatgagcagacagccatcaaggattgtttgaaaatccttgaagaaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgaaaaaaaaaaaaaaaa

SEQ ID NO: 67 - DNA, 889 bp, Homo sapiens
gtggccgatagctggtcctctttctccaacacctagcctgagacttggcggcgcggctgctatcctgaactagcttggtaagtgttgtgtcccgaaccagcgtagagagacctcggaccagccgccttgatgacagcatccgcgtcctccttttcatcatctcagggtgtccagcagccctccatctacagcttctcccaaataaccagaagcttgtttctcagcaatggtgtggccgccaacgacaaactccttctgtccagcaatcgcatcaccgccattgtcaatgcctcggtggaagtggtcaacgtattcttcgagggcattcagtacataaaggtgcctgttaccgatgctcgtgactcgcgtctctacgacttttttgaccccattgctgatcttatccacaccatcgatatgaggcagggccgtacgctgctgcactgcatggctggagtgagccgttccgcctcactgtgccttgcgtacctcatgaaataccactccatgtcgctgctggacgcccatacatggaccaagtcgcgccgccccatcatccggcccaacaacggcttttgggaacagctcatcaattacgaattcaagctgtttaataacaacaccgtgcgcatgatcaactcgccggtaggtaacatccctgacatctatgagaaggacctacgtacgatgatatcaatgtaagccatcccggccagcccctgacatctgccatcgatcttgcaccaagactgaacttgaacactgacattttgttagtaaagaaaaccggatggtgccttgttaaagggcaagaaaaaagggagggggttggagttttgaacgtagtaagccttaccttaatagaattaaattcatgaaacataaaaaa

SEQ ID NO: 68 - DNA, 3094 bp, Homo sapiens
gtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattggtatggcatgcatggagtatgaaatgggaaagaaaaagtgtgagcgctactgggctgagccagtagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcctttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagacttctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattgtcttttacttttctacataaacataaacttcaaaaggtttgtaagatttggatctcaactaatttctacattgccagaatatactataaaaagttaaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaag

SEQ ID NO: 69 - DNA, 2263 bp, Homo sapiens
ctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttaaaaaaaaaaaaaaaaaa

SEQ ID NO: 70 - DNA, 2390 bp, Homo sapiens
ccagcctcggagggagggattagaagccgctagactttttttcctcccctctcagtagcacggagtccgaattaattggatttcattcactggggaggaacaaaaactatctgggcagcttcattgagagagattcattgacactaagagccagcgctgcagctggtgcagagagaacctccggctttgacttctgtctcgtctgccccaaggccgctagcctcggcttgggaaggcgaggcggaattaaaccccgctccgagagcgcacgttcgcgcgcggtgcgtcggccattgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaagtgaagactaattcaattttgcatatagaggagccaaagagagatttcagctctgtatttgtggtatcagtgttggaaaagagaaatctgatactccatttggattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctctgttgtaatccaaaggggagatttgcagcatgcttgactttaccaattctgatgacatctttacggacactattatcactaagaccttgttatggcgaagtctttagtctttttcatgtattttcctcatgattttttctctttatgtagtttgagtatgccttacctttgtaaatatttttgcttgtgttgtcgcaaaggggataatctgggaaagacaccaaatcatgggctcactttaaaa

SEQ ID NO: 71 - DNA, 861 bp, Homo sapiens; identical to SEQ ID NO: 60

SEQ ID NO: 72 - DNA, 1593 bp, Homo sapiens
ctgggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaaaaaaaaaaaaaaaaaa

SEQ ID NO: 73 - DNA, 3633 bp, Homo sapiens
atgatggctgggaccagctgctggtatccttcatgtcctttaataggctccaggatgacgcctgagccaaaggccctacctcctgtggccttggttagagacaccgaaggccagctgtgtcttccccagcagagacaaagaggttggcaggttgtcatggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactga

SEQ ID NO: 74 - DNA, 3161 bp, Homo sapiens
agcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtg

SEQ ID NO: 75 - DNA, 4681 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaactcactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtattgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaaatttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaatgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataacttcgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 76 - DNA, 7941 bp, Homo sapiens
cacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtggggggactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaaaaaaaaaaaaaaaaaaaaaaaaaaaaaaaaaaa

SEQ ID NO: 77 - DNA, 5065 bp, Homo sapiens
atgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctctcatgctggtgaatgcctctgggagacctgaggggcagagagcccacctgctcttaccccaacttaaggaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggcccgaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggctttctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaaaaaaaaaaaaaa

SEQ ID NO: 78 - DNA, 2808 bp, Homo sapiens
gtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggtcccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttaaaaaaaaaaaaaaaaaaaa

SEQ ID NO: 79 - DNA, 3643 bp, Homo sapiens
ggagtatgagtcacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaaaaaaaaaaaaa

SEQ ID NO: 80 - DNA, 2395 bp, Homo sapiens
cggggccagtctgtttccaggtctggcggggggccgggctgcggtggcggcagcggtgggagatgccggggcggccggcggaggcccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagcgggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctgaaaaaaaaaaaaaaaaaaaaaaaa

SEQ ID NO: 81 - DNA, 2653 bp, Homo sapiens
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaagttgaatgccatggccaaccgagcagctgggaaggggtatgaaaatgaagacaactatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaattatcgacctgccctattttctatcctcactgcagtaatgtgaaagtgaagtggaaatattgtcacaatggtcaataatgacccttttgagggtatggagagatggtatacagcaggtaactgtgaattgcagaataaattgaaagaaaattttaaaaaaaaaaaaaaa

SEQ ID NO: 82 - DNA, 6300 bp, Homo sapiens
cggccgcggtttccaggaggaagcaaggatgctttggacactgtgcgtggcgcctccgcggagcccccgcgctgccattcccggccgtcgctcggtcctccgctgacgggaagcaggaagtggcggcgggcgtcgcgagcggtgacatcacgggggcgacggcggcgaagggcgggggcggaggaggagcgagccgggccggggggcagctgcacagtctccgggatccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcagaaaagcaagaggaaagggcacgaatatacaaatattaagtattctctagcggaccagacgagtggagatcagagccctctcccgccttgtactccaacgccaccctgtgcagaaatgagagaagacagtgctagagtctatgaaaacgtgggcctgatgcaacagcagaaaagtttcagatgagaaaacctgccaaaacttcagcacagaaatagatgtggactttcaccctctccctaaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccctctacttactaaacaagtcacaagcccagctcagattcaagaaaagggtgtgaagtagaggtgcagttaagtggggggccactagtctaacagacggtcacaaccagtgccatggaaaaccaaggatattagcaaaagcagaagttgctagtgaccttgggaagccgaagctgcttacagtagctgggacaagctgaaagtcagactaagaaataaagagagggccttcaagaagcttcctgaatgatttctgctagccctgagcctatttttggaaccagcacttggggaaactgatcttgtgaggatggatgtgtttagggacacagggcttttgagagcagcaccaccccactggggcatccccagacttgggaaacgtgactctttcttaatgccactgggttttagtcaggccacagtgagaaggaacagccctaacaggcctccagccaggttgaatgagctcatttttgttgtagccaaccagtaagatttgctaatgttctacattaagtgccttctccaaagacatccctctttgcctcatatgttgaatcatccagtgcggatatttcaatgaaaatatcattggttgacttttgtgatggtaataatgctatggcatctttgccatgaagttgtggcctccttggattcttctgactttggcttctgaaaggaaggcctagatccagccctggtggtagttcctttctgaggtctctcagtcccttgagactttggggtagtttggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgtaaagaaaaagattccagttcagtatttgcagcaagaagcttgaatgctgttctttttatcgcattgttacatcgactcattctccattttgctttggttttgtcttgacttgacttgactttgggggtaaagtctttcaccagcacacaagagtttgattgtacaaatatatcttctgcattaacatctctgcctgttgcttaagatcagttgcttttatactcagaatggaaatacctgatcttggctagttttgttataagatattgatttcatttagatttccctccacgaggtcagcaaactatcatgttcttatgtaaacttaggccaaggccagagttatcatagtccctaggttgctacggcttatcatgtgcttggtaaaaggtgatcgcaggttctcagacgagtttactttacatgagatggaatcaggcagagaggctgggatgatggagaaagctcgaggtgaagttttaaaaaaaaagttgtggaaaggaaagttccaaagaggtggtttctgaggaagtcagagcgcccagggccagagcagtcagtaatgggtgaatgaggttgtttggaaagtcggtgtgacagacacatggatgccatctacttctaggttgctggtgggtattaaatatgcacaatattccatagctcactgaggattttaaaattataagcataggattttatattttggggtgaaagaattatctggcacattaggtattggagtttaaaaaaaaagccaaatttcacagtcttaataactttttttaaaaaaaactaaaaggcgcttcatgtccagtgtgtggcccttctgaaacttatggtcatctctcccactgaaaccaaggtcttttcaaatgtggctaaatggggatgaggagacacgggtaggactttcttggtgtgtgtgcattctttaaagagccaagttgcttcggggaaacagccaggaaaatggtcaagattatttttagaggttattttattggggattttaagaactaataacatcttgagttatttttaattcagggggatgtggaaaggtttgcaattgtcaagtgttttgttgtagcttagtatccataagggaaacttagactatagacataactacaaagccagtgcagcttttgttttctgtatgttgttgggggatcaactttcacacatagcaagcacatggcctccctgatgtcaggatgcctttgttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgtctccccacctatatttatgggtgttagcgcaactgctttgctagttgcaaagctgtattatcagagtaaaagtgtatttgtaaactgtatgggaactaaaaattaggaataaaaccattttcttatatgaaaaaaaaaaaaaaaaaa

SEQ ID NO: 83 - DNA, 194564 bp, Homo sapiens
gatcttaaatattttcaccacaaaaaactcaggaggctgaggcaggagaattgcatgaacctgggaagcagaggttgcagtcagccaagattgtgccactgcactcccagcctgtgtgacagagtgagactccgtctcaaaaaaaaaatgctatgtatgttaatgggaatgttaattagctgggttgtggtaatcatttcacaatgtatacacatatcaaaatatattgtacaccttaaagacataatttttacttgtcaattatatctcaatgaagctagccaaaaaaaaaaaaaaaaaaaaaatgcatcccagccttgggcagtggtagacagtggattcaatggttaataggatgatacggctgggaatgactctcagaaacatgaggacttggttggatggctaaccatccccagtcaacctcgtaaagaggaaggcaagaggcctggagccagaccccagagttaaaatcccaatccaaagcaaagtctcatggcaaaacattggttgatatcatctttctttctttctttttttttgagacagagtctcattctgtcacccaggctggagtacaatggcaccatctcagctcactgcaagctccgcctcccgggttcacgccattctcctcctgcctcagcctccggagtagctgggactacaggcacccacaaccatgctcggctaattttttgtatttttagtagagatgggatttcaccgtattagccaggatggtcttgatctcctgacctcatgatccgcctgcctcggcctccctaagtgctgggattacaggcatcagccactgcgcccggccgatatcatctttctagagccaacgacaagagcagcacttatttcctgtaccatgaatttgtgggatgattcagaccaaattcctcagccctcttcaggacattttggctaactgaggtcttcttgtcatgttggagaaagggagcaagatggggattctgcacaactcaagccccaacatgtggggacagactcaagtagatcaccactgaggctttttgtggtaatgtggatactgggaagcctgaggaaggctgtggccacaaacaggctcattgaatttaccccttgaaatctgcacagaacttggacagctcactccccgatgagccaccacatttatacctgcagctatgacctttctcttgagcctcagacccttatatcctcctgagcactggttatttctactttgatatttaaaaggcccctgaaaactaactcctctgaaactgttcatgtggacaattgacgtgtcagaaccaaaccttagacttctccaaacttactgtccctcagtacccctttgctgtgaaagcaacatcatcctgacaggtgttcagaatacagctttgtggtatttcttgacttattccctggttgtctcttctccatcccatcagcaaagcctctatccctaccttcaggatgtgcctgtgtcttaccacttctttgccttcatgtgttcttggcaccatcacttcttgacaggatgactgtggctgcctactaacaatattccttctcctgcccttgcacccagtctgtgctccagccagcaccagaatagcctcccaggtcactccccagctcaaaaccccaatatatttccactcatcagagtagaagccaaattatgcccatcacccatgaagtccaggctgagctggccactggttatctctctgatctaactccagagctgggccttcgctcactctgctccagtataaaaggtcaccttgctgctccttgaatgcacgaagatgcatctgccccagggcttggcatttgctcttccctctgccttgaattgctacccctgatacccaaatgatggtctctcttctgttccaatctctgctgaaatgtcaccttgtcaataatgtcttcccagatcacttgtagtgatcatccattaggaacagtgttgacacccacccccaaaccaccaccccctattaacttcctgccccatttctcttgcagccctcattatcattcagcatgccaaataccatccttatttgtgtatttctctccttcattgctagattgtaagtttgatgagggcaggatttttttccactttgtcactgctttatctccaatgactcttacagagtaagcacacagtaaatgcctgttaaaagaacgattgaattgcatgaggacaaagaaacttttattttactgtcgtaacgccatgacttcctccaaatctccatgtggatctctatgccagcttttttctgcctctacttaattttctccaagaccttccttggaaatatctgtatgcttaggaagttttaatagtaaagagtggagtaacagctaaaaataaaataagttatgaaatatacctagcagccatgaaacctcaacttataaaatgcagaggccagatttgttacatcctcatctgttgggggtggctgaggagttggtctttgtgtggcctaaatcagaacttggatggcaaaactgactagctcaaatctcaggctagtgaaatctgcaggaagagtgggtaaggcttgtgaaaaacgtaccaaactacagaagcagggatgccagcggaaagagatttttgattaaagaatgcaatagaatgctgaggcctctagaagaggcaggagtgaatctcctagggaaattaagacattaataacagctgtctatgtgggatatttggaaaaatagtgcacacataggcccatggaaggtgtatgtccaaagaccataagcatttacattagagtgattaacaaaggtcttcctctgtgcagagccattcttcaaagattgggagaggtggccatttaatccaaattgcagttttcaacaaaaacttacaaagcatataggaaatgggaaaacacgcatagcccattcaaagcaagaaaatgaatatccagactcatctttgaaaaaacacaggtctcagacttactaaattaagatttcaaaacagctgtcttaaatatgcttaaagggctaaaggaaaacacagacaaggaaataaaggaaatcaagaaaacaatatataaacaaataagaatatcaacaaagagattggaattgtaaagagaaccaaatagaaattctggagctgaaaaatagagtaacctaacagaaaaattgactagaaggatacaaaagcagacttgaaaaggcagaagaaggaattagcaaacttgaagataagtccattgaaactatcgagttaaggagcaaaagataagagtgagaaaaagtaaacagagcctaaaagacaccatgcaccaaacacatatacattattgaaatctccagacaaaagaaagagaaaagggcagaaaaattatttgaagacgtagtggccaaaaacttcccaagttggaggaaagatgtaaatatacaaatccaaaaagttctgtgaatccatgttggttaaacccaaagttacccatagtacattcatgcataattatgtagcatttgaagataaaaaattttgaatgccttttataatagcatccaaatacatagggatacatttaacaaaagtgtgtaagaagactataatgaaaactaaaactttgcagagaaaaataaaactactgttaatagataacttctttccaaatatatctatagatgcaatggaataccattccaaattctagttggttgttaaaaatagaaactaacaagctgatttaaaaatatatatggaaattcatcctagaatatataaaatatatatggaaaaaacaacctagaatagcccaaagaattttgaaaatgaagaaatttagagacattacactacctgacttccagatttaagataaagtcacagtcttcaagattataatgtactggtgaagacaacacaataaatcaatgaaaaagattccaggaataaacccacacatatatggtcaaataatttgttccacaaaaacccaaaagcaattcaataggaaaagaaaacaatttttttcaaaaaataatgtggaaacaactagatatccatatgagggggaaacaaacctcaacccttacttcacaccctatataaaaattattccaaagggatcataggcctactcataaataaagtaaaactagaaagcttttagaagaaaaactaggagaatatctttatgactttgggtgtggacataaatttgttaaggaattgacagaaagcactggccacattgtttcaaaaaaattgagttcattaaaatttaagtcttctaaccatcaaaagacactattaagaaacagggaaatctcagactgagagaaaatattcatatgtatctgtcaagggacttatgtcaagaatatattttctaaaagttgctacaattcaataataaaaagactaatatttaaattttaaaatgtataaaagccctgccctccacaatcttcaatttatagcagaaagcaaggaacacacacacacacacacacacacacacacacacacacatacagcctgctcaaagtgagtctgccctggaacatgtgggaagctggtctagctctgcataagaagtgaacactgtataaactgacttagtggagaaggtcatctgagaggaaatgagccctgtgcactgagctctgaagagcaggagggctgaggtggtgcaggggatggtggtgtttgtgggacttaaagtaagattatctggaattatctgggtgggtccaatctaatcccagaagtgcttaaaagcaaagaacttagcccagaagcagaagacagttgcatgcacatactacagtttggttattcacttcccagtggatggacatttgggttgtttctagttgcgtgctgctgtaaacacttttgtgcaaggctttttgtggacatgtgtttgcatttctgtacatgttgtgagttaaatggaagaggtatgtataaatgttttaagaaacttgcaaacagttttccaaaatggttgtatcattttacaccatacagtaatgtatgagagttgctgttgtgttagtagtgattagcctttttcattttagcaattctggtaggtctataatcatgtcaggaggcaattttgatctgcacttccttgatgattaatgatgctgggcatcttttaatgtgctgatttcccatatatcttcttttgtaaattgtcagttcaaggtagagattttagcatatggtaaatgggtcacatattgggttcaataacgaagatgtggaggggtgggtctagagttttctattttagatgcagtgagattatgctgagctcagtacaaagtgaatcttcccagagaatatcctgatttggaccccaccaaggctactaagacacagttgtgtaattgactgaagcacaagctggccagagcagtgtggagatggagatgccgtctgcgctcaagtctaatgatgtaaggaaaggaggagcttccttatgagagtactttccgttctcagcaactctgagcttaggttggtgatgggcaggagtgagcagagttcaagtttgaattctttgaaaggtaaaagaagcagggatgttctggagatggtgagcaaaatgagaaaagctcagaaacttggtgttgaaattggacatggccagggggctagagggaggaagcaaatggaaaccagagggaattgggaaaaaatgccaaagtggggcccatggagttgagaagacacatagagtaccttcgggttcagttcctggcatggccgctgagccaacttccccacagccatgagatccactgctcagagacccgctctccaccccgtatcccctctaatcactgatgggctcatacctaacatggctatacttggatagtgcatggtgcctgacagctttacaagagttgtcacgtaagcaacagtggtacattgcttttcatttatgccgagtttcacagtttaacttcccacaaacatgctaactgtgatttgtgcagagcataattatttccatttatagaggaagagactgagattcagaaagattctgtcttgcccaagaatacagatcttggcagagctgaccataaggccaaaggaagccatggagatcgttgtgaagtgtgggaattgctgcaggtgacatctaaaaggagatttattgaggatcaaggcagaggtccccagaggacaaactgtgcctctgattccttcctgctgcttttcttcctggcagaaatagatgattgaattcatctttctcctggcaccttgtctcagagacttcccttgccacagttccagacccatccaggccatgactgccatgtagatgacacacctctctgctcacaaataactggccaagcctgaggtagccacgttttggagcattgataatatgggcttttcctgtgttgcccctaaacatgttgtttcattttgtccccttgtcatggggtcttcacagaactcctgtcttagaggataaggaaaggctcttgctctagcaactgtagacaccggtgtgcgctaaagagggaggtgaaccttcgtagaagaaggaaaattgttttggagaaggggatttttggatcagtgcttgtggctctgactctctttctgaaaggaacacccaagaatatgaggattttctgtatctagagcttgaagactagccttctccagtattttgcgctcttccttaaatgatcacaatatagtctgaggtcagctttcttcaaaaaggaatgaccttacaggcagagaagatagctataggtggagactgttacctcatactgtagactcagatgtgtaggataggttcagatccagctgccaagctcaatttggagtacctgccattcttggtactgttcattctgaactatagatttctttgtctgcttctctaagacatctttctggcttgtatttagtgcttagcacaccaaaccactgtccttcaattatgataacagtgaatcatttctgtgtgcttactatataccacgtaacttagtatacagcctgtaactcatacaagttaagaattttttttcattttgtcatcacaaccagtaggtgaggtacttgcctgcttttctcactagctctgaccaccccaagatcatccctgcatgcttttatgaccacaacccttgctgtttcgtggattggcctgagtgtgagcggttcctgtcttgtgttcactctctgctctggagagtcagctgctgtcaacaagttttcttctccaccacctctccaattcatcttacccatactcagtacttccctgggctgaagccaagctctcccaggcagcctggctgggagctttgcagtcaggggctccaacgacttgtagcagtgagctgctgataccacccactgttcgctgatgagggagccaccacagaagtgctaaccagcattcagggacacctggtaggggagagaattctcctcacaggtgtagcccccaatgatcttgtcatcgtcgtcaaaggggacagcaactggagtggaaataggaagggagaagtcagtagtatgttaggggtggcgctcccagcctgcggttgcttcctgctaattagaaatccttaataagcacagtgaaggcaggcaagagagggagcgctgccaccccacccctggtgagcatcactggatgtggctcccaagtctctgtgtctgcagggcacttaggtaccctgcgggggttcagatctccttacagcccagcctgggaaatatgcagtgtcacctccaccacaatccagccagctcggattcaagcaaagggcactcatgggaagatgaccactggccagtgtgtttcatcaggctggcatctttgaagaccagataccacaccgacctccagtgatccaaagtgctgggattacaggcatgataccacaccacagtcatttgaatttgtcattacttggtactcttatttttttccctgctgctctttttgcattgaagtccttttgggatgacgtcaataaaactctttcatgtttttaagattgtatttgtttagtatttctttttcaacctttctacatgtagcctttttgttgtttttattcttcaggtgggtatttcataagcattgtgtattttttcagcctcatgatttatacaactagaatccttagtccattgtcttaaatgtatttctgtatagttttctatagtaggtgatttccttggttttgagttatgtttcttattttgctttgtacattaatttttctcacattttggtttcttcttcccttgtccatgaccttatttttgttcactatttttgtcatttcattattttgcctttcagaagtccacagttcttttcattttttcatgattaactgtaacattttattatataattatgttaagaaaatctgagattagtcttatcgttacccttctcctgaagcctatgcgaactttggaacaattaacacctatggttcccttcatgatttccaatattttggataatcagaatgctaggtctatcacaactagaagtattattgttttattttaccaatacttaattacaattacctatctatgtgttaaccatcatctttaatcgtcactgtttttgcacaaaactttactataccaactcagagcagaaagaggatccatcatattctgtgtctgccccattaagcatgcttctttgctgcatggtctttgattcctggtagcagattaatcccaggcaaagatgtagagccctattatgggctatcagaccccaataccatggcttttcttgtgccacagccctttggtcccatgcctctgactctaacttctatctccttttccaacagttctcatggatactgaagtcccccagacaccaagaaaactggtcacattgactaattttaagagatggcattgaagtagtctcaaaaaatgaaaagtcatagcacatactagctgttgacaatgtatggcttgggctatggcaaacccataacacaaatggaagtgtcaaggaagaaaaaccgccatgagcattaaggaacaaaagagtatattataggaattaggcctgacacaatttggagagaagatggataagtgaaagtttgaaaagggtcagaaaacacaactctaaccagctctggtgaaggtggatgaactggactttgcattaagttttgcattaagttgggtatatccatgcactacatggaaccctgaaggggctggtgtaggaatctatggaagatggctgactctatgtgccaacagccctgtgagttctcagacaagtttggtagtgggactgtagtccctcctggtcagcagggctggcagtcggtataaagagctggatgtgaagcaggggaaagtcagcataaattggaactcactggcacttttgatgctactcctcactgcctggagccagtgatgacttcagaactcagtggcagctgttttactttccccttacaaacttcatgcatttcttccctcatgttcaactctaacccagaaccatactaggaaaaaaagttatctgaaacacattccttgcttagctaggttgacacagtgataaaacaccacaggaatatccagatgctccttgacttgcagtggggtaatatcctgataaatccagcatagattgaaaacatcataattcaacttacaatatccagcttatctgtacataaccccatcataagtcaaggagcacactgaaatgcatattgcttttgcaccattgtaaagctgaaaagtcattgaaccatcatgagaccatctgtacctgacaattagtgtttctcaaaataaataggaagattttcttccgatctgaaggtcttccagccactccctcccagacatatcataatattgggccagaggtcacccatagcaagctgtccttacttactctttgcagaaaaagtacagttacagtatgaagtggcctcattttaatgaggcccaacatacccaagaaataaaaatgcagccacaggagcatacagatgcccttcaatagatatgtcaatattaacataatgcaatagctatatttgttataaaatgatttcactattgcacaaacataatatgatgggcgaagtcttaatcttatcttttctagctacctatgccagagaagtagaactaaatattaaatgaaagcacaattgggaggctgttataaaaatgaaaacatagggctttcaaaacaactttccagctccttgtaattgctacacattttcaacgtcaatccattaaaacaagtatcccagcatgttcaaatcaaagaatttcttatgcctcctagaaactagtttcactgtccagtacttagtatgacctccattacaagagaataaatgtaactaattattctcacaacctcaacagtgattaacacagaaacatacaagctaaatcgagaaatgttattagaatgtttagaattaagtccatctatatgtgagggaaattgtcatgagatactcacgaggtaactatctcatttagaaaatgacgaagtggcttcaacatgattatgaagaaacattggacttccagccgaggcactggcctgggcattatcaatatttatggtagtgccaacctgtaggtctagtgattaacaaccatgagttgtcttggtgtaattactttgaggatatgaaacagaagcagcagactccaatgccattcattacccaaacatacactcctttccttacaagaaactcgcttaagtcattgcaatgctctacgtctcagtgtatctttaataaatttggaagttgaattgggaaatctttaggccactttagacactgtatgggttttttgttttcttttgagacggagtctcattctgtcgcccaggctggagtgcagtggcacgatctcagctcactgcaacctctgcctcccgggttcaagcaattctctgcctcagcctcccgaggagccgggattataggcgcccgccaccacgcctggctaatttttgtgtttttagtagagacggggtttcaccatgttggccaggttggtcttgaattcctaaccttgtgatctacccgcctcggcctcccaaagtgctggaattacaggcgtgagccacctcgccgacctgtatggttctttgacaggcagagagatggatgtaacacgggtcatgagcaaagattaccaccagggggcagactagagcatccttgggattctgtgatcagtcatccctcctcgctggtgaatggagacagtggtcacaactctccccagagaaggtggtgtggggccatcacggaagatgctgctgcttctgctgcttctggggccaggtatgagcctccttctacctgggagcttgggtgggcatgtgcgtgtgttgccatggtcaagcggtggccaggcaatgtggattgtttatgctcatcgaagggagagggagcggccctgctctctagaggtgtaaagggtaaggtgagagccgccagtcagaggagataggggattatagccctagggagatgacaggaagattgcacaaaacaaacaggattctccaggagctgggagcacggggagggagggaggctgagctcggcctggcatcctgtctgactcggctcccactgggctctcctctctctggcttctgtttcagcaggctccgggcttagtgctgtcgtctctcaacatccgagcagggttatctgtaagagtggaacctctgtgaacatcgagtgccgttccctggactttcaggccacaactatgttttggtatcgtcagctccggaaacagagcctcatgctgatggcaacttccaatgagggctccgaggtcacatacgagcaaggcgtcaagaaggacaagtttcccatcaaccatccaaacctgaccttctccgctctgacagtgaccagtgcccatcctgaagacagcagcttctacatctgcagtgctagagacacagcgccaggaggggatcagagaccgcggcaagaacccctgcagctgctcctccaccccagcaggcccactgagtgctgagaagggaggcgtggagaatggaaaaccacagctttcctgactgagacatctgggagtgtgtgtgcagggggtggggcaggggatgggtagggggagaaaaagaaaagaagcactgtgagtgtggagtatggaggaggtgtagtgtttgagacccacgaaatggcaatagagttgggcctaaagaggtaagtgaacatggaaagttccctgaaaattataaaacctagaattttgccctgactctgccacattagtcatgtgttcttgaatagatctacatataatcctagaggtacatatgaagacagttgtataaccactgtgtacttcctataataaacttcagcaattggctctctttcttgtcatcatgctgggctctcaagacaaagataaccaagaggcagccaagtagagagttatgcatgaacacattaccttaggggaggatggcaacagcattgaatagcatccactccaaatttgtgttctgtcctccttggaccaggaccacgaaaataaaatcctatcacatttcctgtaaatgttgaatgccatcatgttctccacggtgtttcagttgatgaatgaacagggtaagactcggtacaaagggaggggagcacctctatgcctaggtacacaccatacggaacgtatccctagggaaggtgctggtgacctggctcctgggaaaggtgtcaagggaaagagggggcagaggtacctagaaggaagacctcagacaacatggcttgtctaaagagttggaaagttctgccagtagctagaagacagtaagtggaacagtgaaaatcctttcctaggagaaaccaaacatttacattgaccacaaatctgtatgagccaatagaaaatgagcaaaacatatgatcatacatttaatagaagaaacatgtatgaccaataaacatatagagatattttacttcattgatgatcaggatccaatgatacatagctttatatccacttgattagcaaaatataaaaagtctagaaatataaaatgttagcgagggtatggattcataggattacttataaattactgatgggagcataagtactataaaccactgggaaacagttcagcattatctcacagttgaagattcctatatcccatgactcagcaattccacttctagatttacatcaggagaggctcttgcatacatgactcagcaattccactcctaggtttacatcaggagaagctcttgcatacacatatcagaagacataaatacaaaagtgttttcaacagcaccaaacagtagaaaaacatggcaccaacccacatatgcactgaaaagagtgaatgaataaactgcggcatattcatatgagtcaaaatgaatgaactatagtgaagagcaaggttataggtgaatcttagcaatataatagcaaatgtaaaaactaagcctaatgagatgatgcaaagtataacgtgcttttcataaagctaaaaacaagtcaagaaagtaattttcaggactaaaatatattagatcaaattatattgaaaagaaagcaaagaccacttgtatgctgcagcctaccttatcagctcatgggagctgactgtatacatctttcccaactccagttttagtgacatcattttgttagcttgaaactggccatagtgagggtatttacactacagaaatcagcaaacacaacaaattacgctttgctttattttcctccagagagttagttgtcaaccctttaccaacacactactggcagggaataataatgacccaagttcaggatttttataaggctggggcatggcaggagatagaatgagagagaactacacagctatacatttaaatattctaaaggtctatcttgcataatgttgaggaggagatattttacaagttcctattatgtttttaaataagtaattattcattgacaagaaagtcctgtgtgttattaaccacaggttaagataaataaaattgtatgcatatagaatcaaaaagaagagaaaataaaacaaataaatgaatagattagagttcttacaagaaaaggattaagaacattttatagtcaaaaccaggagtgaaatagcagtgggtcacctgctaccatcctcatatagacatcggctgctgaactaatcacagcggacaacctaccacccaacagacctggacccttgtcaacccctttgcaacagagagcaggggtttagacactaagggtgaacgtgaaagcatggagatgacgcctggcccctgaccaaggtggaactgcctggaataagatgggagcaaattccgcagtggacacgctgctgcttttcatctccactatgaccacgtgctgctggtggttaaataccccacctgggttcagtcacctcagactgtgccattgtcactgaactcaaggacccattttaattgtagccttttactctgttcgtgctttcagcctggagaacagagctagtaaaattcttttaaaatattccaccgcttcactaatggcatggaaaagacaagagcttttaaggctctggcatgaaatagggagacagttgttacattcctatttcatgcagtcactatttccctctacattaagctgaggagtgtagtgtttcagtgacatttagcatggaacagtgctgggttcagacctgcctttcccaaacaagctgacttgtcaggacacagcccactgcctacctacattaccttaggaaagaagacaacagcgttgaacagcattcagtccaaatttgtgttctgtcttccttggacaagtaccaacaaaatgaaatcctatcacatttcctataaattttgaatgccataaacttttcatgagcaattctttttggagtgttggactttctgttctgattttatattctactctttgggctttgttgtacttgaaatcaagttcacctttcagaggcagtgatgggtgaggtaagagatagactcttacatcttcctccccaacacacacacacacacacacacacacacacacacacacacacacacacacagaggcactgtgtttcccagtaacggagaagccatggggagaatttcagaggttttttttgagatggagtctcgccgtgtcgcccaggctggagtgcagtggcacgatctcagctcactgcaagctctgcctcccaggttcacaccattctcctgcctcagcatcctgagtagctgggactacaggcgcccgcaaccacgcccggctaattttctgtatttttagtagagacggggtttcaccgtgttagccaggatggtctcgatctcctgaccttgtgatctgcccacctcagcctcccaaagtgctgggattacaggcgtgagccactgcacctggccaatttcagaagttttgagggagctagggttttctaattcttctatatccttggatatctccattcttaatgtcaaaaataatctctggagctggttccaggagtctcaacccatttgctacagtacatgcaccatctcaggtgtccaaaggtgaatatttgattaactacttcacagcttcatacccctgctgctgtttttccattctggaatgtggaaagcagtgtgactcctattaactgaccagtagtcaatttcaactacccataaatatgtgagtgtcttgtatctgtaatcccctatctggtgccatttttggaaaccagttaagactcttttatcctaaaaaaatgaactatgttgcatttctggaaagtaattattgatgaaatactccctggagagtctgaagcccctgatattgtatatttaatggttatcctccttttaataaaaggtatgggaagaaattttaaatattattcctaaataccttacatcgagatgagctagagttaattaagtgggacgagggataatgaattcgagggcatttaagaaagattaaagaaccaatgcaaaatgttttaatcaggaaagaaattggtgtgtttaatgacagaaaagaagtcagcagcatggcaggagctggggggaggtcggtgagtacagggcaaacttgaagaaggcaggaaggcatcagaccactcagaaccttactggtcaaggtaaattatacagaattcaacataaagcttaacaggagacactgaggttttcaacatttgacttctgtagtaatcagattcgtggctgtgtatctgtgtatttaatcaccctggtcacaaagtgaagaaataatggactgtgcagggaagacaaaatgttacctcttccctcttagggtttttcggctgggcctgagaatggaacagattaacaggaggaaagcatacacatgtatttaatataagttttacatcacatgaaaggccccataattaaaggaagacctgaatatgcagttagaattcaatactcatatactcagttgggcaaagagtcatacattgtggaaaggtgaaaaaggggcttgggctagggttgctggttgaatggcaaagtgactaggaaggtgagggttagtttaacaagcttttttggtatagattccttggcctcaacatcatcccctcctacccttcatgttaagaatgttctttctttctggtatagataagacatcttttatatgggaggcttattccatttttcaagaagaaaaggggaagggtcagagtactcttatacctgctattgtctttaatgactctagctcaaaataatccttatgccaaagtggcatattttgggcggagggttgggggcttatgctgccaccctccagcagtgtggacagagttgatgcggagaaaaaagttagctcaggcaagcagtagtttagctgggataatgatgatggtgttagaaatatggggaaaatgagacatttaaaaggaagaaaatcaaaggacttggcaattgattagacatgagcagcaatatgcagggggtggggggtggtgattaagagactgcgacagacagacaaataaggaggaccaagtgggaagaagatcaagatttactttgagattgggagtgcctttgggacagtaatctaaacaagaatatgcagggagcagttggatgtacaagtcatggactcagaaaatggatctggataagaagtacacctttgggacatttagcatcactggaagaatgaaagtgcctccaatcccttgatatagagtttacaatgaaaaaagcagagaacataggatagagatttaggcagcacacctgccttgggggactataaaaggttgagggaggcaaaatgcactgataaaccaccatcggcattagactaatggctgagtaattgtgtaagtaattgctagtaataatgctgtggagtacgtgcctggtaccacaccaagtgctgcttttttcttaattccgctctgatacttgggatgcctccctgctgcctcgctgcggggcgggccactccccacccaggcaggccgaggcagagctcagcgggcatcggatgaattcgcccctttgaccactagagggtgatgtggatctttctgtaaaatatctgctgctcatcaagtgcggactcaagagcttcacctgtgttcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctacactaactttgatgctgagcgggatgctttgaacattgaaacagccatcaagaccaaaggtgtggatgaggtcaccattgtcaacattgtgaccaaccgcgacaatgcacagagacaggatattgtcttctcctaccagagaaggaccaaaaaggaacttgcatcagcactgaagtcagccttatctggccacctggagacggtgattttgggcctattgaagacacctgctcagtatgacgcttctgagctaaaagcttccatgaaggggctaggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgcccaggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggtccagcgcattcagaacaagcccttgtattttgctgatcagctgtacgactccatgaagggcaaggggacgcgagataaggtcctgatcagaatcatggtctcccgcagtgaagtggacatgttgaaaattaggtctgaattcaagagaaagtacggcaagtccctgtactattacatccagcaagacactaagggcgactaccagaaagcgctgctgtacctgtgtggtggagacgactgaagcccgacacagcctgagcgtccagaaatggtgctcaccatgcttccagctaacaggtctactaaacatacaaaagtttagccgggcgtggtggcgctcgcctgtagtcccagctagtccggaggctgaggcaggagaatggcttgaacccggaaggcagaggttacagtgagccgagatcatgccactgcactccagcctgggcaacagagctagactctgtctctaaataaataaataaatgtaaggggcgcggtggctcacgcctgtaatcccagcactttgggaggccgaggtgggcggatcacctgaggtcaggagttcaagaccagcctggccaacatggtgaaaccccgtctctaccaaaaacacaaaaaattagccggacgtggtggcgggtgcctgtaatcccagctactcgggaggctgaggcaggagaattgctggaacccgggagtgcagtgagctgagatcataccattgcactccaggcagctgggcgacagggtgaaactctgtctcaaacaaaaaaaaaaaagtttgaaataagtaaagatatacaacatgatcatgaaaaagtgaatccaataatccaatagtaagtttattttaatttctgcagtattatctatatattcaatacgacagtaatcaaactacaaaatatttatttcatgaaatttggcatataatctacaactaagtgaaaaagaagaacaaaaataagcattatttaagaaggacagaaagtgacgtgaattgctctaccaattatcaaattatgttatcacttaggataatgaaagaagcgtgattggccgggcgcggtagctcacgtctgtaatcccagcactttgggaggccgaggcaggtggatcaggaggtcaggagatggagaccatcctggctaacacagtgaaaccctgtctctactaaaaatacaaaagaattagccgggcatggtggcgggcgcctgtagtcccagctactcgggaggctgaggcaggagaatggcgtgaacccgggaggcggagcttgcagtgagccgagatagcaccactgcactccagcctgggccacaaagccagactccgtctcaaaaaaaaaaaaaaaaaaaaaaaagaagcgtgattaaacaggcaaatggaaaagagaaaatgaaaaataggtccatgaatatataggaatttcacatatgatagaggtgttattgaagctatatggaggaattatgtaatatacaataagttattctggaacaggtggttatccatacaaggaaagatgaatttaaaccttacttcacaatatatgctaaaataaatcacaagtggattaaatgcttaaatgcaaaattcaaaatgttaggtgttttggtaaataataaggattatatcttcatgaatttgggctatgggttttttttatataaagaatttaaaaacatgttcaccccaaataaaagaataatgcattctactaaattaagaaatccaacaaaaagtagcacaaagagagtaaagacataaaccacaaactggaaagatattaggaacacatatagctgacaaacgttgggtatccagagtctataaaatctgttacaaataaataacagttaatcaaccaaaaagaaatatggacaaagggcagtttacagcaacactggtggcctataatatataaaatatgttcaaccttcttagcaaccaggaagaagcaagctaaaactatattgtaccatgagataatattaacaaactagactggcaaaattaaaagtatattaaatagcaagtgtagtcctagatgtggaacatttgaacacactcatgaactgttggtgggatcatttatttggcttaatcactttggaaagcattttgttatgttatgaagttgacatgctgacttgaagactcagtctttacattgccaggtatggcaacaatcttccacctaggtaagcagagacatgttcaagaataccatactgtttgtagcagcacaaacacccagggaaaaattagtgtgtattaattcaagaatgaatcaattctagccaatgaatataacgtaatactagatagcaatggaagtaaattgtctagattatgtgtcaacatattatcacagacctaatgttgaatgaaaaaataacattacagaaaaatatataaactagctgattcctcttagacacatttcaaagacacacaaaattaaatactacataatttacagattcttgtgtaaatgctacagactataatgcaaagcaagtgaatgacaaatttaaacttcagtttacatctacctgggcatgatggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttaattctttaatgtagccggacgcggtggctcatgcctgtaatcccaacactttgggaggctgaggtgggcggatcacttgaggtcaggaattcaagaccagccagtgacatggtgaaaggctgtctctactaaaaatacaaaaattagccaggtgtggtggtgggggcctgtaatcccagctactcaggaggctgaggcaggagactgcttgaacccaagaggcaaaggctgcagtgggccgagatcaagccactgaactccagcctgggagacagagcaagatccgtctcaaaaataaataaataaataaataagaaaaaattacttaatgtaaagctgctgctatgtgattttataagtgtgtcaaaagctactatctgtaaagaccgagttgtatgattccttacctgagatggaagggaggaggggaagaagcaaattgacaagttaaaaaagtaaacagagtgtaaattagttcaaccatgtggaagacagtgtggcgattcctcaaggatctagaaccagaaataccatttgacccagcaatcccattactgggtatatacccaaaggattataaatcattctactataaagacacatgcacatgtatgtttactgcagcactgttcacaatagcaaagacttggaaccaacccaaatgcccatcagtgatacactggataaagaaaatgtggcacatatacaccatggaatactatgcagccattaaaaagaatgagttcatgtcctttgcagggacatggatgaagctggaaaccatcattctcagcaaactaacacaagaacagaaaaccaaacactgcatgttctcactcataagtgggagttgaacaatgagaacacatggatacagggagggcaacatcatacacggggcctgttgggggatggagggctaggggagggatagcattaggagaaatacctaatgtagatgatgggttgatgggtgcagcaaaccaccatggcatgtgtatacctaatgtaacaaaactgcacattctgcacatgtaccccagaacttaaagtataataattttttttaataaatgtatgagtgattttacttaaaaaaatagcaaaacagtgagtcacagaaaaaaaaaactaaaagcaggctgaaacttacactatttttaacagctaaaacaaagcctgccctcctacattctctgaaattgaaatgattctgtcccatgtacagagcatctacaaaggctatgggaagtgatcacatcacaagcaggttgctgacgggggcggggggagcgggcggagcgggtgaggaagccttacagaaaaagctaccaccacgatttctgtctgagccaaccaggtgcctcagacttctctgctgtgtggccctttctttctggggagcaggtaagtccctgttctgaactggtgaattccagttccaagactctctcctgtggctgcagtatcaggctccctcctgggctttttttccttcctccacagcctccatggacaccaaggtcacccagagacctagatttctggtcaaagcaaatgaacagaaagcaaagatggactgtgttcctataaaaagacatagttatgtttactggtatcataagacgctggaagaagagctcaagttttttatttactttcagaatgaagaaattattcagaaagcagaaataatcaatgagcgattttcagcccaatgcccccaaaactcaccctgtaccttggagatccagtccacggagtcaggagacacagcacggtatttctgtgccaacagcaaagccacagtgccgaatgttagcccttcttagaacacaaactcattatggacccagctcaggaaataagtgtatgtcaggttggtacacactataataacagaaagccaacttgaaagacaataaatcagaaggaaaaacttgtaaataacagctctaagtgagcaaaaaacaaagggggaggggtacttaaaacagctgatggggacaaaaccccagggaaggaagcagaaggcataaaaagctcggattcctccgtgttcaggatattagttaagatatactaagttaccttctgtctctcttttcatatgagctttagggatttctaacaatctttatttaaagaatgggattctgtgcttttcacttggtaaagctgtgagttcagaaataagaataagcaaatcaactgtgtctttcaggtagaccctgatcatctgacccagcacatttccttgaactagagacagactctaaagggctttttgactgcttctcacagctcttcctgccatagaagtttagtaggaaccattagcaattcccaccctctggaatgttacaatcacaaaaatttttaaagcacctttattgagacataagatacatgtagaatacgtaggcaataaacatatgcaaccgatgcaacaaaacccaccctcattgtaagtgtatacttcaacaaattttaacacatttttatacccatgtaaccatgatgacaatcaagatacaaaacattttcatcatctcaaaaagtcccccacatctctttattgaggtctcgttaatttctctcagcattgctttgtagtttttattatacagatctcatacatattttcctaaattttattttaataaattataaatgtactcaataaaaatattctctgccaagatttcacatcagcctgactcagcctaattcaatttcatctttacatttttcaattgacatctctacctcagcatattacataaaaataccttctccagaaattgcatatggtttggagcaaccatatgtgagctcacagcgtcagcctcattcgccatgtgaaccaatcaagtgttagtgctgctctgtttccaggtaaattatacgcattcacatgtattggaaaagctgtgaaatttctgcaaggtgtactttaagaagaggtatattttgttaatgaaaacatacctatgagttaagattaattaaagggaatattttgcagttaagcacatgatttggaatgaggggttgggtgttgaagccctgctggtcaagcctctgaattccattcttgtttctcccataggccaccttcatcaggtctacagttctacaatacagagtgtcagtagtagggaaggtcgttcatgtgagaacagggaatacttgggattctgtagtttctgctcaactttgctgcggacttaaaattgctccaaaaatacaattcactaatttaaaaatggatacaagtattcagatggagaattaccatattggaggcacgaaatgggaacatactgttgaatctgttgcaatacaggaagagtgtttaatgacaaactttattactcctttgtctaggaaataggacactatttaacactgactacaacgaggatcttaaatacagtagaactgtctaaattctatcattaagaatagtgtatatattaccaatatagggatctgaggtgtctcagaattagtaacacatagtactgtagagattattttaaaacgtagtgtggagataattttgtgattccattttaggaatactatttctgattacatggtttcttagcgtaaagcctcactctttcatgaaagagagtatatactatcatactacgtccctgtagttttctattccaataatgctccttaggaataaaatatacatgataatcatgatgatgacgtggataatgatgaatataattgataatgcagacagtatgtagaaagatagatgatagaatttgtaccatgtttccaggactagaatacaatcatggtaagtataatataaaacttgttataattgaagtctgtaaacagtctaaagaagtagtttaatttttttcccttgacaccttgacaaatctgcaaactacacatataggctaagtacttccgaggctatatgaacttcctaaaaaacatttcctctctgtggattccagcataatgcatattctcttctaaggcagaagtttttaacctgggatccatggacctccaagtagtgcacagataaaattcagggaatccataaatttgaatgggaaaatagatctttattttaactaatctccaactgaaatatacctttccctctaagatatagtgagtaaaccagagtagttttagtaataccagtgacaaaatcaattgcagaaatcacaaacatttgcttacatgttgcataagtgacagttgatataaaagtcagatattttcatatcatgttacatgcagtaaatataccttcatcactatgttgaaatcgtgacagttttcagattcatcaggttatattttatttaatgaaatttaaaagtgttcctatattaatatatgaaaatttaaaaaaatattttgatgtctgcatttcaaaataattgtttttctatattctagtttgtgcatttaaaatgttatcctgagatggggtccctaggatttaccagtctgacaaagaggtccctggtacaatgtgaagaactcctggacacagaattagatcctcaacgcaggcatgattgacaacctgaaacctagactcacgcattggaagcaaccatgttggaagcattctttctcagagttttacccacactgctgcacctcttaatgcttctcactttaaataattactttgcattctctctctttctctctctctctctctctcactctcgctctcctgctcttttattttctctctctgccttctgtttttcttctaggaggaaatagcaacagcttctaaaccccaccagcttgcaaccaaaagtttcatcatgaaagcatcttttaatggcagataacctcagaacaacatttgtctaccaaaacaaaagcattcattaagaaatcatcggaattgaacaatgagaacacatggacacaggaaggggaacatcacacactggggactgttgtggggtggggggaggggggagggatagtattaggagatatacctaatgctaaatgacgagtgaatgggtgcagcacaccagcatggcacatgtatacatatgtaacaaacctgcacgttgtgcacatgtaccctaaaacttaaagtataataataataataataaagaaatcatctaggatcctatttttatttactaaatctattgggaagaacctatgttatacagtgaatttacactcatacaaatttctactcgtgttggaaaatgatactttagtcagctggtacaaccctatgaccataaatgtctgatttcacttgatatagtattgacttcctaacttcctgtgaattagaatatcaggtccagaacgtaataatagcaaacacaaatatagtgtttcttatgtactaagaactgttctaaatgctttatttatgtaatgttcatcacaggtttgggggtagttacttattatctcaattttacaggtaaagtcagattgaagagaggctctgtaacttttacaaggttacgtagatgctaaatggcacagacaggactaaagcccatgccgtgtcccaagtccctgctctaatccattgtcacaaggggaggggcacttcagacgctttgctattcctaaaattacaggagtagcgcctaccccatctctactgtattaattatttatagtaaatacagagagtgtcgagaattggttctttaaaaaaaaacaaccacaaaaaactaaacttccaaaccccttcttgtgttgagttgagcacaggtgcatggcactctgtgtatgactctgaccaggaaatgagggattggctcttctgaccatgcaggcaggcacttgtccatttagaagggatataaaaagcttctataagcagaagaggaggtgcatgtgacttgatctctctaattcttagtctcaccatctgcaaaatcagctgtgacaatcagtcatcatgtagcaatgacaaattctttatattaagccctggggaggggctagatctcagcctctctctctctcagagcctgtgtctgtaacttcagagagacttcatcgctgccatgggcagctgtgtcctctgctatgtgaccctgtgtctcctgggagcaggtgagctcagcacacatccagttggtcaattcctatcctgggcttgccaggcccctccccggccagcacctcccttctgggcatgatctctagcctttgtctcttggacccttggatgctgacatctatcagacgccattccagctcactggggctggatgggatgtgaccctggagtagaaacaatttgagacacaatgacatgtactggtactggtactggcaggacccaaagcaaaatctgagactgatctattactcaagggttgaaaaggatattcagagaggagacctaactgaaggctacggtgtctcccgagaggagaaggggctgtttcttctcatggtgaagctggcccacaccagccaaacagctctgtacttctgtcctgggagtgcaccacagtggaagcacagccattgtctctctgtgcggaaatgtgtcctagccctgtagtccccaccacatcctctagtttaattttttcatttttaatattttcttgagattttcctatgtcctgttacttttgcaaacacaaaggatacaaaactgaaaagaaaatagatcctttatccaaggagctaagagtctagcaagaaagtaattataatagaacggaaaatatcatatataatactacaatcagaagtcatttgggagcttcagggaggacatgcacaattctgtttgattgaatgagaaaaagcaaagaggaagtcccattagaacctcaccagatagacctggttctgagtagagcattccaggcaaagagaacaacttttgcaaaggcatattaaagagtttgacactttggggaacagtttacaaagagaaagatgatgatcaatgtatatgaatcaaaagaaatggaatatatctgaggaagtagaaaggagtttttgaaaaagttgagtttttggttccatgaatataataagtatgaaagtcctttgtaggctgttgctcaaaagagagagctgaagcttgttatcagcaaacaagcaaatgatacaatttttcaattttcctcatataactttgatcatttacaaagggcacaatttcaaacaatatgaaatcacgttagcagtagcagttcccatttgggataatagggttcaactgtctatggaacaatcagataaaaactagaagtacgcaactgcatagacaagatgtgaaattgagatgccataaagctggactagaggttgagattctgcagattacagcatgtcaataattgaactgtggggacagaaaattccacccaaatatagatttagatcacagagataaaatgcatgggaattaagactgtagtattctggttccttatggagaataaagaagcctgagagtgaggagtgattagaacatgggatgtaaaaacaaaagagggaaagagagagagtgagagttttgttttgtctgatatttctaagaaaattagggaaaaaaataaaggtaacccaggcagaagaagccacaaacacttcttgggtaacagggaatagtcggtaaaatgttatatgttagtttactgaggtgaacagaaccttttccattgaggttccatttggaaagacataagacttagctaagattccaagaaatcaccaaagtaggaaatgaaaaacctccatgaatgaagttgcatgagtctgcctaccagtggataaaggataggataaaagaatagctgcaaaggataaaagaatagctgaggcactgaagtagaagctccaagtgagaggactaaatctaacagacatgaagaattattataagagaattattataaaaccacaataataaaagtggtataatataggggcattgatatataaatagatccaaggaaaaaaatacatgtgcataaacacacagcaatggtactgcaataatcaaagaatacatttttcaacaaatggtgatgggaaaattgggtatctatataaaggaaaacaagtgcaattggacacatctcaatacatagccaaaatcaatcccagctatattaaaagcataattgtaataaaatcacaaggcttctagaatactgtataatataaaaggacatcttcatggccttaaagcagggaaagatttcttattccctcaatcagtagggaaccgattgataaaaatggctatataaaaactgatattgaatttatcaaagttaattatataagagtgacaagattgactgtatagtgacatatcattaaatatctatatatttataccaaattaatatccctatctatatttatatattcaagaaaagctagtatatataatttattttttaaaaacctagaaactaatttttctccagatcaatgagaaaaaggtaactgtcaatagaaaaagtgagtgaaaaccataagctcccagcaaaatctcactggtcattaaacatgtaaatgttgctaaatttaataatcagggaaatggaaattgagtccaacgaaatatatacccacaagaatctctacgatggtaaaaatagtaatctatcaagtgttggcaaggcaaaagtgtcaacaagaattctctgaatcactggctagagtgtatattggtagatctaagttggaaaacaatttggcattacctagtaaagttcaagatgtgtgtacccactgtccatcaattccacccttgagaaaggcttttctagagaaacacttctgtgaaaatcaggacaaggatattcactgtaatacatctgtaatagcaaaaatgcatacaatatccaaatgtaacttaacagaagagtaaataaattatggtttattattataaagaaattacacagcagtaaaaattcatgaactaaaactaaacacacaaacatgactgaatttcacaaatttgaagaaaaattacattacagaagaaaggtacagtattgtctcatttgtataaagtttggaagcatgtaaaactaaacacttttgtttgcttatgtacctatgtgttaaaatatgaaagagaagcaaataaatataaaagcaaacacctcagtagagttagagaacagaggcatgggatctgggaaaagaaatgagtgctttcaaatattctggtaatattttatttcctgtgccaagttgtttttttaagtggtcattttgttggtatgttatcaagttattgtctatatattcaaagacaatcttgtaatgtggaggaaacaacctcactgaacaattaaataagtaaggagaaatctatggaaagatatacattaaactgttaacattacttacctgaaatgaggatgagatggaggaagaaaaaagtaaaaaaataaataaatcaccaaaaatgcactatttaaaataaatagttacagaaagaaaagcaaaaaagggaggttatctaaaagaaacactagtaaatgaacaagctaaaatacaccaaaaagagctaaaaggtgaagtatttttcaaagcagtggctagtttcagaatcataaaaatagcaattacaatagagatctatattatactaaaagataattagataattaatagccagaagaaatgtctagtcgtgagttagaaactgatgctcaaattaatggcaaaggacatttttgaaacaactgtaaaactctgcataaaaactaaatagcagataagatgaaactgcattgatgagaaaggatgatgatcattaactgaaaaaaaaagcttatcaaacagaatttcaagaatattgtttataataaaaaataatgtgtctatatatctacacatttatatatggggagagaaggatctagaaagactctcactaatgtgttaacagtgataattgctttctggcagtggtatatttttattttgttattttattttctaactttctaaaatatcagtgctttgcttatattagcaaaaatagacatacaatattttaaatgaatacaaaataacttagttatatttactgagttaggaataaaagctttttttcccgataccatgaagtgtttttgctcagaaacatgaagcagtaacaagatgattatgaatctgtggagcaatcacgtcacaagaaggtgcagacggggatgaaaaagcctcatccctttgcgacgtcaatgcgaccacgggcaccaggcttctcggctgggtagctctttgtctcctggcagcaggtgagctctgagcacagaataaaaacccttgtcctgggctggccaacccccagatccaagctttgctgttgttgttaaggtctttcctggactctgtctacagcatctgtttctttctcttacaggctgttttcatgccaaagtcacacagactccaggatatttggtcaaaggaaaaggaaggaaaacaaagatgtattgtacccccaaaaacggacatacttttgtttgttggtatcagcagaatcagaataaagagtttatgtttttgatttcctttcagaatgaacaagttcttcaagaaatggagatgcacaagaagcgattctcatctcaatgccccaagaacccaccctgcagcctggcaatcctgtcctcggaaccgggagacaccgcactgtatctctgtgccaccagtccgtccacagcactgaaatgtcagttcctgttagcacacaaacttgccacagacccagctcaggaagcaggtgatgtattaggttggaagggagtaacagaaaataactggagccagcttaagccacagtggaatttaacacaaggataaagggtgtttagcagaagtcaagaggtgatggacagacagttctgaaaaggacagacagttctgaaaaggcaccactagggccaggctctagaatgactatctctccagctctgatttttattcagttttgcagctgcatgcttttctctccctgtacaccatccctttttctccaggcctcgtggtgagaatgagatggtcactaaagattacaaattcagttgccataatttccctacagtgacaaataccaccccagctctttctaagcctgagttcaaaatcccaggagaaaaaaacagatccgtcatgatccagccatgaaccttctcatagagcactcagcagtaggcatgtatgtatgtatttaaaatcacataaacgttacttttccactcagctcaagcaagggaaatgctctgtttttcagtatgtacattcggtctgttggttctgtatgatagagagtactcatacccatttcttcagaaatacatacccagattttctctggtttccggccagaattgaaaattattgtacaaataccttcatagacttgtatgattgctttataggattatataccaagaacaagttgtgattgctgagacatgtaattctatgcatattttatctatctaaatgccaccacaggttcttcaggatcaccgtatacatctgcaatcccacataaaagtgaatagggtgttttcctacatcctaatacctcctttaatccttatccagtgatctagattgttatcagtatagcgatgtaaagaggttccaatctccctctctctccatcccctcagccctgctcacccaacaccagaatatcatcagtgtttaccataaagaaacaggtgacaattcttttaaaactaaataaaaccaataatttaaaggaactgagagattactttatactactataataataggtggcaacaatctagaaagctgaataatgttctctccctccttttctttcccttgcatttttctaactactaatgaatttgagcacttcttcatgtgatagtggtcctggatttctgttctcaaaatggcctatccatatcctcaggcaaaattctctattgagagttctatattttcctcaacaatttgtaggaagtcctaagatatacaagatattagtctcctttttgaaattttaggcactggaaataccaccacccaatatggcaccacccctgtcccagacttcaaagaattagtagatgtgggaggagccaggtggtctcttaccttagtaggtgcatgcgtgttatctccattatgtgaatgagacttctatctttcacttccactctgctgagtgctcaacatgctgtctcttccattattactcatgtctttaagcagcatagaaaagttaccagccatggctgtccccaaactactgtcacccatcgacatccctttccatccagaactgctgaaaaaaatgcttcacttcatttagctgtgcttttttacaatctggggtaaatctgattcaaattaattttcattgctctaagtagattatgctgtctgattatagcaaaggacagaaaaacttcacacatctttttggaagacttaatacttgcccacacattatctcttttagggccaaattccatccactgcaaacaccaatctccttgagctcttgatatgacagctgatccattttgattccgcaaatgcttgcaaagcaactcccattcactgagacatataggcactgagaaactttcagctacactacattgaattttgatttctggggaaagggagaagagtaaaaagaaccataaaaatgtatttcaagtaatgtgtataaggatgacaaaatatagattactttcatgaaaaacattagaacattatattctctttgggagtgatttatcattggataaattaaaacaaattcctgaggaagtctgggaaaaaataaatttaggaaaacaaattttaaatgatatcctgaaaaccatcagggtttaccataaagataacaatctaaaaaaatccaacaaacaatttaataatgaatgagaaaatatgaatacagaaaattcatatgaatatggaatgagatattagtaaaaatgtgcttgagaacacttacaaatgaattttgttgtccaatttgattaagagtctagtcaaagtgttactcttttaaactacttataatggtgtcagtttgacaatatggaacaaaaacctttaaaatgcttatttttgggatttggctttaaatcaaaagagatagttgttactgtacttgtcctattgccttaagccactataaaacttgacaaaaattataagacaactattttcagacatcagacaacaggcagtatggggttgccatcactgagaaagaggaaacctagaagggaaatttcactattgtcctaagactctgtcttggtatgatttctgggccgcagctccaggatatgaagcccaaggagggggcagtggtctctccagcatagggaggcagagattgaattcagagctgtggacatggctgatagtgatagggataagctactgcagagaaggaagctatgcagaataagacctccaaatattgtatgaagtctccttaactctttggtcaaaaacttagcagcaaatgcataggaaaagcctccataagacctggcagagagcagttgctgggtagctgtgagaggaatggagattctgacagtcatacgggcatgggagataggaatcctgaccgggcagagctaagaggccttgctgaaacccctgggaatgcagctggcaccacataggggtcacatctcaagagaaggactaccaaagtcgtagagtaaaccaccccagaactgccctaacaaagctcagcaagtctcaaaaggatctaactgatctgccagttaagtttgctgccttttgaagaaaaatatctcagcactctctaaataaaggcaaatatatatataaatatatacatatatatataatctgtagatatatatgtctgtagagagagatatatctctagagtgtcaacagtgtagcatctacaattttgatcttgaaatgaaaaaaatattagacataggaagaactaggaaatgttacacatggggaaaaaaaataaacaataaaaaccaaccctgaaataacacaaatgttggaaatttcagatgagaaattttaagcagctattatagaaatatgttcaagaatttggaggaaaatatggtcatgatttaatcaactgatgaaattgattaacccataacaatcaagacaaaatggggaaagacacaaattacaatatcaatgatgaaggaaagcatatgtctatagacacaaaagacattaaaatagtgacagaatattataagtatatgcaatacattcttcaacttagatgaaatgaaattatttgaataacaccatttaccaaaatgattcaaaatgaaataagaaatgtaaagaacttcaaatgaaggaagttaaattttttatcaaaaatcttctctcaaagaaactctagacctgaattatttcttcatgaattctataaaaaaaattaaggaaaaaagactatccttcttacataaactttttcagaaaatagaagaggaagaaacacttcacaacacttttataaacccagcagaaccctaatgtcaaaatctgtcaaatgcattacagaacagtatctttcacggctgcaaatgaaagaaaacttttcacaatatatgaacagattaaatccaaatacgtctcaacaaaatactgacaaactgaatccagcagcacatcaaaaagcttatcctgggatgcaaggctggttcaacatatgcaaatcaataaacataagtcatcacattaacagatctaaagacaaaaaccacatgattttctcaatagatgcagagaaggccttaaataaaattcatcatcatgttaaaaactctcaataaactaggtattgaggaacatacctcaaaataataagagctatttatgacaaacccacagccaatatcatactgaatgggcaaaagttagaagcattccccttgaaaacgagcacaagacaagcatgctctctctcatcactcctattcaacatagtattggaagttctggccagcacaatcaggcaagagaaagaaataaatggtattcgaataagaagggagatagtcaggttgtctttgtttgtagatgacaaaatcctatatctagaaaaccccactgtctcagctcaaaagcttcttaagctgataagcaacttcagcaaagtctcaggatacaaaatcaaagtgcagaagtcacaaacatttctatacatcaacaacaggcaagcagacagcaaaatcatgaatgaactcccatttgtaattgctacaaagagaataaaatacctagaaatacagctaacaaggaaagtgaaggacttcttcaagaataactacaaaccactgactgctcaaggaaaccagagaggacccaaacaaatggaaaaatatttcatcctcatggataggaagaatcaatatcatgaaaacggccaaacggcacataataatttatagagtcaatgctattcccattaaactaccattgacgttcttcacagaattaggaaaaactactttaaaattcatatagaaccaaaagagagctcaaatagccaagacaatcataagcaaaaagaacaaagctggaggcatcatgctaccggacttcaaactatactataaggctacaataaccaaaacagcatagtacgggtacaaaaacagacacatagaccaatggaacagagcagagaactcagaaatggatcacacatctacaccatctgatcttcgaaaaatgtgacaagaaaagcaatggggaaatgattccctatttaataaaaggtgcagggagaactggctaaccatttgcagaaaattgaaactggacttcttcctcacaccttatacaaaaactaaatcaagatgtattaaggacttacatgtaaaagccaaaacaataaaaagcctagaataaaatctaggcaatatcattcaggatataggcacaggcatagatttcatgatgaaatcgtcaaaaacaattactacaaaagcaaaaactgacaaatgggttctaaagagctcctacacagcaaaagaaattatcatcatagtgaacaggaaacccacagagtgggagaaaattttgtagtctacccatccgacaatatccagaatctacaagacatccaaacaaatttacaagaaaaaaaaacaaacaaccccattaaaatgtgggcaaaggacgtgaaaagacacttctcaaaagaagacattcatgcggccaacaaacataccaaaaaaaaaaaaaactcaacaccactgatcattagagaaatgcaagtcaaaaccacaatgagataccatctcataccagtcagaaaagccattatgaaaatgctggcaaggttgtggagaaataggaatgcttctccactgttggttagaacctaaattagttcaaccattgtggaagacaatgtggtgcttcctcaaagatctagaatgagaaatactatttgacccaggaatcccattactgggtatatacccaaagcattataaatcattctattacaaagaaacatgcatgcatgtgttaattgcagcactattcataatagcaaagacacagaatcaacccaaatgcccatcaacgatagactggataaagaaaatgtggtatatatacaccatggaatactatgcagccataaaaaggaatgagatcatgtcttttgcagggacatggatgaaactgggagccattatcctcagcaaactaacccaggaacagaaaaccaaacgttgcacgttctcacttataagtgggacctaaacaatgagaacacatggacacagggaggggaacaacacacactggggcctgttgggggatggagtggggggagggagggcattaggaaaaataggtaatgcatgctggacttaatacctaggtgatgggttgataggtgtagcaaaccaccatggcacacatttacctatgttacaaacctgcacatcctgcacatgtactccagaactaaaaaaaaaagtagagttgctataaagtactctatgggggggggggggggcgggaactagataattcactcaaattttgattagcaaagtcttccaaaaattaattttcttcaaaaaatagaaaatatacttttggatcaaaaataaataagtaataaatccaaatatgtatgaatatatgtatatatttgtgtgcatatacatatgtgtatatgtgaacaattctacaacatgaccaagtgagtttattgcgggagaaacagtggtttagcattccaaaatcaatatacttcaccatatcagcagaataatgaggaataatcacttgaccatctcaacagatgcagagaaacctttgacacaatcagtactaaatcaaaagaaacactatcagtaaactggtaagacagttatctcaatctgattaaagttgtaaatgaaaaatttacaaataacatctgattgaatagcgtgttgagcactttcctcctataatataataagacacaagccatgaagtttactcattactttttgctttaattatagatgagggctcactatattccccaggtgggacttgaattcttgggcttaataaattattgtgctaagctgctcactatttttattcaatattatattggagatcttaaccagcgtgataaagcaacaaaaataaaagttttaaacattgaaaaggaagaagtaaaagtacaattatttgcagattacatgattgtttacatagaaaatcataagaaatcaaggaacaacaactagaaataattagtgaatttaccaatatcacaggatacatcagtattttaaaaatcaaatttttttactagttgcaaacaattgaaacacgaacttcagaaaataataccatttacaatagtaccaataacaaattacttaagaaaaatttagcaatagatgttcaattaaaaactacaaaactccacaaagagaaactaaagaaaatatttttaaatggagagatatatcatgcttatggattggaagtttcaatgcattaagatggtaattctcaacaagtatgttggaaaacctggataatcatatggaaaaaatgaacctttactgccacctaccaccataaatgaaaattaaattgagatgtttcatagatgtaattataaaagctgaaaccacaaatgttctagaagaaaatacagaaaaacatctttgtgagttgagagtaggcaaaattctcttaggacaccaaaaactctaagcagtagtaaagaaataaaattacttatcctttggcagccttttatgtcagaggatgtgtgttatacagatcaataactcacacatggaatgaggggttcaacagtccttagaatcacgtacatacgcacagcacacagatggacatggtctgtgggtaagacaaagaagtctgtgttctgcctgtggtagagtataggtcagagcaaaagtggattataaatacgatttgagaggtacgtgagccagcccagagtagagaatatattggcctgtgccgttaggaaccctctcatttgaccagaaattgggatgcctttttcaatttccttcccaggcaaatgtgtgtcccctccattcattcctctgataatgctcactcactcctcctcgggcatagattctgctcccagaatgatatctgcttctcctttccttgctctgcacctacaaacttctgttagaaatgcccaggaaaacggtctctcaaccactggatatgagtcccctcttctctcaactagtgtgatcaccacgaatagttcatattcagctcccaaatattaattccactcagattagtgcccacagcaggggacagcaaaacagcatgtttactttaagaaatgcaaataagggcaatgattttttttttacattgaagacaaacccaaaataaaagttcttatgatcatcgtcttgtttatattcatcagacccctggctaagccatttactggaacaaatccacatttttattcatattgctaacagagaaccctaaccagaaagagaaaaagggaggggacactggaatatgtcatctggagtgtagacaatagctgtaaaatgcggttgggggccgggcgcggtggctcaagcctgtaatcccagcactttgggaggccgaggcaggcggatcacgaggtcaggaaatcgagaccatcctggctaacatggtgaaaccccgcctctactaaaaatacaaaaaaattagccgggcgtggtggcgggcgcctgtagtcccagctacgcgggaggctgaggcaggagaatggcgtgaacccgggaggtggagcttgcagtgagccgagattgcgccactgcactccagcctgggtgacagagcgagactgcgtctcaaaaaaaaaaaattaaaaaaattaaaaataaaaaaaatttgcttgggtactcctaaataaagcaacaactattcaaaattacacagaagaggcagaagtggtgaaggaggtggcagatgaacaagagaggccatgaggagttggtaattgccaaagatgactcatgtgaggacacaaaggctcattattttattaagcctactttgtatatgtttgaaatttttagaattaaaagtaaaaatatctaaaaataagactttaccaatttgacatgcagcaggaatgattagggtaggatgccatggtgtacccatgcgtgagggagagccagtgacagtgatatggacaggagacagaagtactgggtagaaagggtggtttcccagcaaaggccccaccctcaagcctggagacgtgcagctgtaaatagggacaggcattcctgttttcatccccaaaaagttgtcttttgacccaccatgccccctttcttgtacccatgtaaaccccaaaccccaggcttcagaggcaggcaagcaggctaggagacaagcagagggagggcgaaacgacatggcagagaaaaagaggaggaacgtctgaaccgcgagaggagttcagctgggggtggtcagagaagagttcagtccctggatggccaaactccaaggggaagatcatcttctcaccccatcccctcttccagctccccatccaacccactgagagccactgccaccactcaataaaaccccacattcatccttcaagcccgtgtgtgacccaattcttccaggacactgggcaagagctcgggatacagaaagctgtcacaccggccctccgcctttgcagaaaggcagagggtccactgagctggttaacactcaagccgtgcgcggatggcagaactatctgcacacttgggctcctgcatctgtccgtctgcgtgttccctttcccctcaggggtttgagcccctgcagcaaccgaagaggtgagcaacactcctgttgcacgtccttccaggggggtcagggaactctcctttttcaccaggacaagcacagatctgaagcagcaaagagccagttgtttattacattggacaatatctcacactatcactataactgttctgtgcttgcaatctgctgcattaaatattaaactcttgcctcctaaagtcaggaataatttatttagaataaaatgaattatttaatgaaccactgtattttcagctaattcaaaataggaatgaaggtgttaagtgcttctttgaagcacatacccacattaaactaacacctttctacaataaaccaatatttttaataaagctctgtgcccagaaaacactgaccagaaaagcaggagccactaaaaaattggagcaatttgaaacaaagttaggaatcctgtcattcttaaaacaaaaaagtctcaaactttacagagaatgtattcaaattgcatagtttaccaagaaccgagttagaataaatgattaagcacagaaaaaaaaggagaacaattatattgtcctatcattcaagtgagactagactccctttattcaaaattcaacttggttttgaattttctccagcctgctttatcaggaggatgatgtctccttgaacaactgaaatagatatgccttgagaaaggggagagatacaactctctggtggttgtcagtaaagcaccagagagagaagagaagcaagtacaggaatttcagcatctgctaagaacatctaatacataagccaacatggcatctttaagacccagtaccttggaagggacaatgacatcacttcctgaatcctcctagttttctatttccatgccctgcttccctcaacatccagagctggaaacacctccatcattcctcttcatgccatggcctccctgctcctcttctgtgtggccttttgtctcctgggaacaggtgagtttggaaaacagatggggaaatcactgccttaaattttccaggttctggattaagcctatccatagagattgcagcttgaagacatttaccagtctctgtcttcagtttctgtcttatttctccacagggtccatggatgctgatgttatccagaccccaaggaataggatcacaaagacaggaaagaggattatgctggcatgttctcagactaagggtcatgatggaatgtactggtatcgacaagacccaggactggggctacggttgatctattgctcctttgatgtcaaaatatataaacaaaagagagatctctgatggatacagtgtctcttgacaggaacaggctaaattctccctgtccctagagcctgccacccccaaccagacagcttctaggttacttcagtgccaccagtgatttccacagtgcttcttggccacctgctctctacacagaaagacagacacatgggtgagttgtttgctctgaagggtacctggatgtggtttgtgggatgtggggtgtttagagctttcagtggttttaggtagtgtgagctaagggccactttggatcaatgtcctcaagccatgtgatgaatctgaaaccacagaatcaatctcccctattttattcttcctagggagctagcccaatggtgacctttcaggagaatgaacttgagcatttgacagaagctcatgattttcaacaagagcatttcttataagctcaatacaacgtagtttttatagtctctttgccattatctccacctgctttgcaatatcccacactttgttctgttcccacagacaactcttttatcctgtctaacctttctctgccccagttcttccaagctcagctccaccatttagctctatatttgattgcctttctactaaaaacaaaataactagcttgttttctaaaacttcactgtaagtaaatttaattatcattaaatctgactcagaagctaaagttcaagtatcagagactgatttacaaaagtaatttttcatctactaccccacactttcatctctgctgagattcattttaacgtgcagatgcagacagacttgcaatattatctggatgtactgaatttcaaaaaataaaattccctgtccccagtatgaggtcaaagctaggagcttggaggtgcctgttttctttccaggcactggaataattccctggttcccctgccgtgggagttcttttaggagccagggaggcccaggcacattgatcaaggactgccagagcttgatgtaaaagtcttcctgagagtcaagttgatgtcgtcctcatgggttttgtcttcttgtcccacaagcctcaattatttcagcaaaagaatccatgggacttggtgactgttcagaaagaaagaatccaacttgttcccttttctacctgttctcatgtgaaaagaatgttacgcttagggattctttctcatctgctttctatttaaaaagcaggtttctccagagttttgtttcctgctttctatgcacacctcgtcaagtcttatcagcaataattctttcctcataagctattaactatcccaattaattgtctcctggacatttctgatagattaccccaggatttttccttctgccctcctttttcctcagtatacatatttttcctcaaccttcccattcattgtcatgacaacttctttcacaggttcctgcctggcaaattcaactatctactggacacttccagctggatgctccacaggcaattcaaactcagtttacccctgaaatgaactgtctctccatccttgcacttgcccattttggccacacactgtatttctatctcagtgattggaacagccattctaggttcctcatttttgctatgcctcatattaaatcagtttctaaatctattacttctatatcccacattgtcatggtttgtgttctccaaaagcagattttgagagggaaattagtgtgcgggaatgtttgtggaaactgcccttgcagtccacgtgggcagagagaaatggggcagagggagaagttgggctgtgctgtatcctcaacaaagtccttcactgaccccacagggagctctgagtctggatggtcctttagcgccatcccaaggtgagatggcaggtcttattcccactttccttgtaaccatgtcattgtatgagttgctctgagaagcactcatgaatttaatggggaggaagtgtctctttagaacaaggccattcacagagagatgtcagcatcacagtttctaatgcacacatatttgtctgattcagctacccctctccctcctcattgcttctacctcagtgcagaccctcatcatccattgcctagaaataaatgcaatgccctctccctggcttactagcttcttacctctttcccttaccctatttctcacattgccaccagcatgaccatgtacgatgttccttacacaatacacaaagcccttcagaaatagttctcaaactaaacatctggccaaattggccgaattcactccagcactttagactctagttcaattgaactttttatatttccctgaatataccacgctgaattgcacaggtgtacttttgccaaagctctttccttcatctgaaatgagcttctctattccttttttgtcaaaactaattttttaatttcaacttttattacagattaaagggcacatgttgtgcaggtttgttacatgggtaaattgcgtgaagctgagacttcaggtcccaacgatccgatcacccaggccataagcatagaatccaacaggtggttgttcagcccatgccctgctccctccttcccctgtctagtgagccccagtgtctatggtttctatctttacaatcatgcgtattccatgtttagctcccacttaaaagtaagaacatagtatttgattttctgttcttgcattaattgcttaagataatgtcctccagctccatccatgttacataaagggaatgattttggttgttttttttttgtttttttttttacggctgcatggtattccatggtgtatatgtaccacattttctttatccaattcactgttgatgggtgcttaggttgattcaatgtccttgctattgtgaatagtgctgcaatgaacataatgggtacatgtgtctttatgatagaataaatgatttccctttgggtatatacccagtagtgggactgctgagtcaaatggtagctccattttaagttctttgagaaatctccaaactgctttacacagtggctgaactggtttgcattcccaccaacagtgtataagtgttccctttcctctgcagcctcaccaacatctattatttgaaataaatcttgagtgcctggctaatcctcacacatcctttaattctcaggtcaaagattatctataacagtttttacaacttctgtagacaaagactcagcttttctcttgtgtgtgatagtttatgcatttcaaagttatcatagttgttatgttccttcatatttcttttctttagcttttattttaggttcatggggacatgtacaggtttgttaaacagttatgtgcaaactgtgatgatgatcgcattattttatggttgcatagtattccatgatgtatatgtactatattttcttcatccagcttactgttggatgaacctttaggttgattccatgtctttgctattgtgagtagtgctgcaatgaacatctgtgtgcatgtgtctttatgacagaatgagttctattcttttgggtatatacacaataatgggattgctgggtcaaatggaagttctgttttaagttctttgaggaatcaccatactgctttccatgatggctgaactaatttacactctcaccagcagcatagaagcaatcccttttctcagcagcctcgtaaggatctgttattttttgacttttgataataaccattctgactggtgtgagatggtatctcattgtagttttgatttgcatttctctaatgattagtgatgttgagcatttttcatatgcgtgttgatcacatgtacaccttttgctgaaaagtgtctgttaatgccctttgcccactttttcatggagttatctgttttctgcttgtaagtttaagttccttatagattctggatattagacctttgatgcatacacagtctgcaaatattttctcccattctgtagatcatccatttactctgttgatagtttcgtttgctgtgcagaagctctttaattcggtctcatttgtcaatttttgattttgttgaaattgcttttggtatcttcatcatgaaatctttgcgaagtcatatgactaggatgatataatatttcctaggttatcttccaggggctttatagctttaggtttatatttaagtctttaatccatcttgagttgatttttgtatatgatataaggaagggatccagttcaatcttttgcatatggcaagccagttatccccagcaccatgtgttgaataaagagttctttccccgttgcttgttcttgtcagctttgtcaaagaccagatggctgtaggtatgtggcattatttcctggctctgtattctgttccattggtctatatctgtttttgtacagtaccatgctgttttagttactgtacccttgcagtataggttaaagttgggtaacatgatgcctctagctttgttcgttttgcttagaattgccttgactattcgggctcttttttggttccatatgaattgtaaaatattgttttttctaattctgtgaaaaacatcgttaggagtttgataggaatattaggttaatgcaaatgtatttgcagtttttgcattgttgaaatttgccatttggtattgaaatacattcttaagtaaatgtggttatgttatacatcattttaatgcacgttttcactttatgctttttgctaattacttattacttgatacttatttggtatttattttagactatccacatggtgttagacaaaaagcagattagagagattttcttatttgagttcaaaatgggttgtaaagtggcagagacaactcgcaacatcagcaacgcatttggcccaggaactgctaatgaacatacagtgcagtgttggttccagaagttttgcaaaggagacaagagccctgaagatgaggagcatagtggtgggccatcagaagttgacaatcaccagttgagagcaatcatcgaaactgatcctcttacaactaggcgagaagttgtcaaagaactcaaggttgaccattctacagttgttcagcatttgaaacaaattggtaaggtgaaaaagcttgataagtgggtgcctcatgaagtgagcaaaactttttttaaattgtcattttaaagtgtcatctcttattctatgcaatgaaccgtttcttgatcagattgtgacatgcaatgaaaagtggattttatatgacaactgccaacaaccatctcaatggttggaccgagaagttccaaagcacttcccaaagccaaacttgcaccaaaaaaaggtcatggtcactctttgatggtctgctgccagtctgatccaccacagctttctgaatcccggaaaaaccattacacttgagaagtatcctcagcaaattgataagatgcaccaaaaattgcaatgtctgcacctggcattggtcaacagaaagggcccaattcttgtccataacaacacctcaccgcaggttgcacaaccaatgcttcaaaagttgaataaattgggtacaaacttttgcctcatctaccatattcacctgacctctcaccaaccaactaccacttcttcaagcatcttgtcaactttttgcagggaaaatgcttccacagccaacaagatgcagaaaatactttccaagagttcgttgaattctaaagcatagatttttatgctacaggaataaacaaacttatttctcattggcaaaaaatgtgttgattgtaatggttcctattctgattaataaagatgtgcttgagcctagttataatgatttaaaattcaccaaaaccacaattacttttgcaccaacctaataccatcgaatctatattgctttgggcagtatggccattttaatgatattgcttcttcctatccatgtgcatagaatgtttttccatttgtttgtgtcgtctctgatttctttgagcagtgttttgtaattcttgttgtagagatctttcacttctctggttagctgtattcctagatatttgttgtgtgtggcaattatgaatggaattatgttcctgacttggctcttagcttgtatgtttttagtgtattggaatgccaatttcttaatgttgattttgtattttaaaactgctgaagttgtttatcagatcaagcagctttagggcagagactatggggttttctagatataggaccatgatctgcaaatagggatagtttgacttcctctcttcctatatggatgtctatttcttccttctgcctgattgccctgaccaggactcccactactatgttgaataggaatggtgaaagagggtatctttgtcttgtgctggttttctttttatactggctcttcacaaggctatatattctttagttaagagtagacatctcgatggaccagtgactatcaccctattaaccagtcacaggagcactgccatgcatttggtattttagttttcgggtatgctatcacatcacagaaggcctggtcccctccccatcacctgcagccggacttgtctttgattcctaccaatcacctatattagctgtgcctaaattcaatattccaactgggcgtaaccaccctaaggtgctaattaattcatacttgaaggacataacagtaattaatagacaaacacacacaaccgctccccttattggacttttaaaataaaaatctgcaatgccccctcccccatctctgactccatcaacccaggaaaaaagacaccttgccaaactccaaaaacaagtaagccttaattcaactctgccagaccccaaaatatttgtattttagctttggttatccccaacagctacccctcaactaatgcaaattttttaaagaaactaagcccccaccaatgtaattctacttttacaacaattatatctaatatgcatgcccatccattactaagcccataccctaaatttacacaccccaaaaaacctgtgacttcgtactacaccaaccactcgccagtactaacatctactccaccaactcctgctaactcaactttaaatccctgaaccctacaactgtgaatattgcttgtatcttcttctatactccaattttgcacttaacatatatacagttaatgtagcttaattatttaaagcaagacactgaaaatgtctagatgggcttatacagccccgtaaacagacaggtttggtcctggcctttctattaactcttagtaagattacacatgcaagcatccccatcccagtgaaagtaccctctaaatcaccttgatcaaaagaagtaagtatcaagcatgcacaaatgcagctcaaaacactttgcccagccacacccccacgggaaacagcagtgatagatctttagcaataaacaaaagtttaactaagctatactaatatccagggttggttaatttcatgccagccaccgcggccatacaattaacctgagctaatagaactcggcataaagagtgttttagatctatccttaacaacgctaagcgtcatctaggttgtaaaaaaccctagctgaaataaaataaactacgaaggaggctttaatacttctgaagacacaatagctgagacccaaactgggattatataccccccaatacgcttagccctaaactccaatagttaaatcaacagaactattcaccagaacactacaagcaatagcttaaaactcaaaggacttggcggtgctttatatccctctagaggagcctgttctataatggataaaacccaatttgcctcaccacctcttgctcagcctatataccactgtcttcagcaaaccctagcaaaggctgcaaagtaagcacaagtatctacgtaaaaatgctgggtcaatgtgtagcccacggtggtaagaaatgggctacattttctacacccagaaaatctcacgacaacccttatgaaatctaagggctcaaggaggatttagcagtacattaagagcagagtgcttaattgaatgaggccataaagcacgcacacaatgcccgtcaccctcctcaaatattactttagagattagtttaactaaaacccctacttatttatatagaggagacaagtcgtaacatggtaagtgtactagaaagtgcacttggatgaaccaaggtgtagcttaacacaaagcatctggcttacacccggaagatttcaccataatttgaccaccttgagccaactccagccctaaacttaactaatagtactactgaataaccttaatcaaaccatttacccaaacaaaagtataggcgatagaaattttaccctggcgcaatagacatagtaccataaggtaaagatgaaaaagttaaccaagcataaatagcaaaaatagacccttataccttctgcataatgaattaactagaaatatctttacatagagaaccaaagccaaggcccctaaaaccagacgagctacccaagaacagcgaaaagagcacacccatctatgtagtaaaatagtggggagattcatgagcagcagtgatacgcctcccaagcctggtgatagcggttgtccaagatagaatcttagttcaactttaaatttacctacagagccacttaatccccctgtaaatttaactgttagtctaaagagggacagctctttagacattaggaaacaaccttcatgtagagagtaaaaaacgttatccccatagtcggcccaaaagcagccatcaattaacaaagcgttcaagatcaacatccaaccactctaaattctaatcacaccactgaactcctaacaccacattggactaatctattactttatagaagcaataatattaatataagcaacatgaaaatattctccactgcacaagcctacatcagaccagaataacccactgacaattaacagcctaatattaataatcaacccaacaaatttattattacctatactgttaatccaacacaggcatgctctaaggaaaggttaaaaaagaaagggaactcggcaaattttaccctgcctgtttaccaaaaacatcacctctagcattattagtattagaggcgctgcctgcccagtgacatatgttcaacagccacagtaccctgagcgtgcaaaggtagcataatcacttgttccttaaatagggacttgtatgaatggctccatgagggttcagctgtctcttacttccaaccagtgaaactgacctgcccatgaacaggcaaacatgaataaataagacgagaagaccctatggagctttaatttattaatgcaaacaaagctcaaataagcccacaggccttaaactactgtccctgcattaaaaattttggttgaggtgacctcggagcataatttaacctccgagcaacctatgctaagactaaacaagtttacgtgaattactatacatatattgacccaataatttgatcaacggaacaagttaccctagagataacagcgcaatcctattctagagtccatatcgacaatagggtttacgacctcgatgttggatcaggacatcctaatggtgtagctgctgtcaagggttcgtttgtccaatgattaaagtcctacgtgatctgagttcagaccggagcaatccaggtctggtacatgtgtatttaagtcctccacacctcccatctacaagtctctttagaacaaagaaaatatgtttggttaagagaaggctggaaaaagagggggttttactggacaaaaaatgtatagagacttatgtagcaattattatctgatattaatatctgatggtactacatgattgagaaatagagtgaagtgacataatcccaaacatacatgggagaatgttcggggaaatcaaagctgttttcctaatggaatctgagttttgaaaaagaagacatgcaaagggggatgtatacatatgaaaatatatgaaatatttctgttttaattgttaacacacatttatatactcatatattgaagtgagtctataatatattctaatcagaatatttaataagttaagtttatggctggagtcctagttttagtattagaggcaaagaagcagagttggaaggaggggaatgaattatgcatgctgtatttgagggtctttggaacttccaaatgctggtagagtacacagttggcactctgtatcaatggggtcctcatttgcagatttagtcaacctcagatgaaaaatatattttaaaaattacaaaataacaacacaacaataaaaatacaaaatttaaaacagtgaggtataccaactatttacatggcatttacattgtattagctattaaaagtaatctagagttgatttaaagtatacaggaggatgtgcctaggttatatgcaaatactatgccattttatataagagatttaagcatcagtggatttaaactaatcccccatgaataccgagggaccactgggttgagaacatggtgctgaagctcataaaaagcccttgctctgggattcagacataagacactgcataaaagctcaacacacatcccctatagtcagtgtctgtgattctctggaatcaaactctattctgtgaaaacaggaactgtgatgacacaggctattcttggcatgggaaatgaaacctcagaggtaatcctacttccatgtggtcccagagccctgagctaggagatgtttatcactatttgggaaaccagaaccctcagtctttctcccttgtgcctcatctgaagacaggtgagtcctttgccatcatatgaagtcttaatttagcattgccacattctggttccagatctttccctcctggctgaatattaagactgcattttatctcttgtctttcttggtatctcttccctatgcaaacttcatgaacactggaaggaccaccatgtcctgagaatcaagaaggctccattgagaaagggtgttttactagaacaaaaatgtatagagatatatacaaggattataaataataatgtctgtctctgtaattattcacacttagcaattcccagcaccttctccagagacttccctatctaaaccagaaaggtagtctttggggaaagtgttttcatcaataaaaggcaagctatgcatgagctattcctgcactgggcagcaaggagtgagtagacagttacctctgccttcgagtaccccttcatctgactaggacctgagactctctcatatctacttccaagcccaggttgagaacttctcttctttcctttcttagttgcttctactgtgaggtatagatttaaatccagtcactgccgaagacttccatcaactcatcactcatccttaagtcatctcacattgagaaaaactgggagccttccgctttcctgtttctttaaaatttgtcagaatctccccaaacctctaatatcttttttttcagcagggggctgaaaaagtgctgttctcagcacttactattaagaccagatctcatactaaggtctaaggccaaatctcattaattattttaatggttacttttgtcttaaaggagccactgataggacaagagtatttcagggtttggtaaatcaaaactgttacattccttcgtgacacatgacagaggaagagtgagcaggggcccacatgtgttatatgtaagtacatacagacttgaagacatggtgttcaaatagtagagatataatcataaaaacccaaaccccatgtcagcatcgtgtgaacaaaaattttagtaaataccaactgtaaatctcaatgaactagggcaaaggaagtggacaaagctgggagaaattctgggattaatctttgtatttcacaatcaaaaccaaaggcttttctgttaagaagaaatgggggaaagggcggagggaaaatgacacttggtttagacattgtttaccgcagcagcacccaaaccatttttagcagtattaccaaagcatgtattggattgtattttctgttctgtcatgattgatggtgaaattaaaaggcagatggactaaaatcatcctaggcaaaggctaagttgattaagctgataaaggctgaacaccaagtcaatgaaaaatgagactgagaaagttattatcacacaataataacaccatattttctgaggactcagtgaatcccagttactgctccaagctctttacatgtgtctatatagattgccccatttaatgctaacaagttctcttgctccttgtctgatcaagccacgctgttcactggttctctcttctgcatgttcttctctcttgggtttgcagagttcattcctgttcatccttcagaactcaactcaaatgccacttcctttcccaatctttttaattaggtaaaatcccgctattataggcattcaaagctatgtagtttttatgctcatagcttataaaacagttgcaatggaatattttataagaatattaaagacttgagttaagcaaagcatgaagcctactttggatgagggaagtgaacaaaaatattagtcatttgatgggttaaaaggatatagatgaaactgtttcaacaggatggctgtgggacccaggaagtttgcaggggctgtgtcatcacacacacacaatgactttatcaagagcccatcctgcctccccactactgggagacatcctctgtagccccaactgtgccatgactatcaggttcctccgccaagtggccttttattttctggaggcaggtaagtaataggcacagttcattccaaaatctagaaggaacacttcctctgtgttgggtttgtgcatggctcagcctcaaagttcatcatgaactctgttgccagtttttgtctcttcccataggccttaaggaagctgaaatctaccagaccccaagacaccgtgttataggggcaggaaagaagatcactctggaatgttctcaaaccatgggccatgacaaaatgtactggtcaagatccaggaatggaattacacctcatccaccattcctatgggttaattccacagagaagggagatctttgctctgagtcaacagtctccagaataaggatagagcgttttcccctgaccctggagtctgccagcccctcacatacctctcagtacctctgtgccagcagtgaatacacagtgctacatagataccgacactctgcacagaaagggtcgcctctaaggtgaggacatcttgccttcagaaaccttatcttaaactacagaaacccctgcaaatcttcccagactcctcagccttgagggaccagtgtgctttaagtaacagtctggactaaagactatctctggctcagtctctaacaagctgagaaatgacccagccccacagtcatcctggctgacttcttccttgcatctagttcttgctgttcaattgagcttgcacaaattttatccttcaagataaatgtgatgatatttgacagttgccttatggctagctgaagaaagtctttgtcagctaagaaacaggaaaaggatcctttaactttctgcacaggctttctttatctctggttcatggttccttcctcatgttaaactcgttccttcatacacagccacacaaagtccttgccctttcctgaccccagtcctgcacctgatgacttcagttcctctctatgactttgaacttggaataaatttttattttcacttgaaataagtgattaatgattattttcactaatctccctctaaataaatgtaatttgagctaaatctgcatgaggcctaaggaagagaaaaggctccaactttggaaaagaatagtcttcaacaatgtccctggattcagccctaaatctctttggagactacccttaccagtgggagactatcctacagatagatgattcttctctcttggatatgctgaatctcagggaagtgttctctatccacatgagatcagacctgggaccttgaatagattgatttatttttcacaaaagcacagactactgtggggccctgggtgctgagctcagatgtgaaacttctgttttgaggttaccaaaaagtaaagtcacagagtctctgtcctggttttgcctccttaaaaagtagctttaatatgttagaaaagaatctagaaaacataatacatattttattgtaaaagtcattgcttgttcattcttcttttctgtttgtattctacaatactagccattcctcactcttctttgtgggctctttctattctcattttccttactttgtccttatttctgggctttttattcttttcctcttaacctatgcatacatcttagacaatatcatctaatttattacttgaagtatatatctcattagtttcaaacttattctctagctgcctactagatatttccatctctatatttcataggctcctcaactcaacttgtccccaacagagagttcatcatcctcccaataccatgtcctcttttggagacaccatcatctatcttgggaggctcatctccaatggtcaggtgtccttagcaaacacctagaagattaaaaacccttgcttactgaactcttagcctcatgccttacccttctggccttcttgcaaaagtgatatgcatcagagagttggccctctgtattcacaagttccacatccctggattcaaccaaccacagatcaaaaatatttttttcaaaaattgtgtctatactgaacacatacagacttttttccttgtcattattctaaacaatacagtataacaactatttacataactttgtattgtatttggtactatgaattatttacagatgacttaaagtatttgggagtatatgcaaagattatatgcaaatactataacattttttatctgggacttgggcatttgtagattttgttatccttgggaggtcttggaaccaattccccaagatactgagggataactgtagacaaatgtgatcatgctactggatcccctcaccatttctccatgcttctccttcatattcaagataaaatttaaatttcttcacctggcttaatggtattttgtgatctggactccagaaattagcttatcttgaacaccttatcccagctatttttcatcctggcaatcctgaacttctgaccattttctatagtccatgttctcttacccatctgagatcctgtacctgctgtccctctatctctgaagtccgcacttcttgtctacagggctgactcctactccagcatctcattaatcactatgctaacacaagaagtcttcatctgcttcagtttattcctgtcctccaactagtggtgtgggagggtctcttcatcaccatcctccttattttctaggatatatctctttttggtgcatggttttcctggggcattttgattaagaatggtcacatggtataaatcagacagaaacaaaacaaatcaaagtctctgagtggggatggatgtcacccctgctgggtatttttggatgtcatgctggaagctgatccagtgcaatcctcctcgttctctgatgggaggaagttctagctttgaccctggaacagatcatgatgaatgcttcctggaaagatgccacgtgaattgtggggttcagagtaaagaaataagtgacatgtttatgttaatagatattacttatatatgagcaaacctggtcttgctttattataaaaatagcagctattgctcagttttatagatttattgaagtataatttaaatgccataaaattcactctctgtaaggtacagtttaatgatttatagtaaatttattgagttttacaagcatctcaaaatactttaaaacattcacattgcccccaggagatcctttctgccctttagcagttattctctgaggttccccaccccaggcagccccctatctattctttgcctccatagatttgattttttttttcttttgagatggagtcttgctctgttgcccaggctggagcacagtggcatgatctctgctcactggttcacgccattctcctgcctcaacctcccaagtagctgggactacaggtgcccaccaccacacctggctaatttttttgtatttttagtagagacagggtttcactatgttagccaggatggtctcaatctcctgacctcatgatctgcctgcttcggcctcccaaagtgctgggattacaggcttgagccaccatgcccggcccatagatttgatttttctgaaaaatttataaaaacagaatattacaatatgcagtctttgtttctgactcctttaagtttgcctaacatttgaggtgttcattcatgttgtagcatattttagttatttgctacatatttgttgcagaaaattttttcattctatggatatagcatattttatgtatccactcatcaatttttggacatttggattgctccagttgttaacctattatgaataatgccactataaatgttctcatataaatcttgttggtccattccaaaatggccgaataggaacagctctggtctgcagttcccagcgtgatcaatgcagaagacaggtgatttctgcatttccaactgaggtacctggttcatctcaatgggactgattggacagtgggtgtggcccatggagggtgagctgaaccagggcggggcatcacctcacccaggaagcacaaggggtcgggggagttccctttcctagccaagggaagccatgacagactataccgaaaatcaggacactgtcattcaaatactgggctttttcaacggtcttaggaaacagcacaccaggagattacatcccacgcctggctcggtgggtcccatgcccacaaagccttgctcactgctagtgcagcagtccaagatcgaactgtgaggtggcagcctggctgggggaggggcctccaccattgctgaggcttgaataggtaaacaaagtggctggggaagctcgaactgggtgaagcccaccgcagctcaacaaggcctgcctgcctctgtagattccaccaccgggggcaaggcatagctgaacaaaaggcagcagaaacctctgcagacttaaacatccctgtctgacagctccaaagagagcagtaattctcacagcacggtgtttgagctctgagaacagacagactgcctcctcaagtgggtccttgactcctgtgtagcctaacagggagacacctcccagtaggggccaactgacacctcattcagctgggtgcccctctgggacaaagcttccagaggaaaaatcaggcagcaatatttgctgttctgcaatatttgctgctctgcagcctccactggtgatacccaggaaacagggtctggagtggacctctaccaaattccaacagacctgcagctgagggacctgactgttagaaggaaaactaacaaacagaaaggaatagcatcaacatcaacaaaaggacatccacaccaaaaccccatctgtaggtcaccataatcaaagaccaaaggtagataaaaccaaaaagctccctatccctctccctctccccacggtctccctctccctctccctctccccatggtctccctctccctctctttccacggtctccctctgatgctgagctgaagctggactgtactgccgccatctctgctcactgcaacctccctgcctgattctcctgcctcagcctgcctagtgcctgcgattgcaggcgcacgccgccatgtctgactggttttcgtatttttttggtggagacggggtttcactgtgttggccgggctggtctccagctcctaactgcgagtgatctgccagccttggcctcccgaggtgccgggattgcagatggagtctcgttcactcagtgctcaatgttgcccaggctggagtgcagtggcctgatctcggctcgctacaacctccaccttccagccgcctgccttggcctccctaagtgccaagattgcagcctctgcccggccgccaccccgtctgggaagtgaggagcgtctctgcctggccgcccatagtctgggatgtgaggagcccctctgccccgctgcccagtctgggaagtgaggagcgcctcttcccggccgccaacccgtctaggaagtgaggagcgtctctgcccggccgcccatcgtctgagatgtggggagcgcctctgccccactgccccatctgggatgtgaggagtgcctctgcccggcagctgccccgtctgagaagtgaggagcccctctgcccggcagctaccccgtctgagaagtgaggagcccctctgtccggccgccaccccatctgggaggtgtacccaacagctcattgagaatgggccatgatgatgatggcggttttgtcaaatagaaaagggggaaatgtggggaaaagatagagaaatcagattgttcctgtgtctgtgtagaaagaagtagacataggagactccattttgttctgtactaagaaaaattcttctgccttgggatgctgttgatctatgaccttacccccaacccgtgctctctgaaacatgtgctgtgtccactcagggttaaatggattaagggtggtgcaagatgtgctttgttaaacagacgcttgaaggcagcatgctccttaagagtcatcaccactccctaatctcaagtacccagagacacaaacactgcggaaggccccagggtcctctgcctaggaaaaccagagacctttgttcacttgtttatctgctgactttccctccactattgtcctacgaccctgccaaatccccctctgcgagaaacacccaagaataatcaattaaaaaaaaaaaaaaaagatggggagaaaccagagcagaaaagctgaaaattctaaaaaccagagtgcctcttctcctccaaaggatcacagctcctcaccagcaacagaacaaagctggatggagaatgactttgatgagttgccagaagtaggcttcagaaggtcagtaataacaaacttctccgagctaaaggaagacgctcaaacccatcacaaggaagctaaaaaccttgaagaaagattagacgaatagctaactagaataaacagtgcagagaagaccttaaaggacctgatggactgaaaaccatggcacaagaactacgtgacgcatgcacaagcttcagtagctgattcgatcaagtggaagaaagggtatcagtgattgaagatcaaattaatgaaataaagcaagaagagaagcttagagaaaaaagagtaaaaagaaacaaagcctccaataaatatgggactatgtgaaaagaccacatctatgtctgattggtgtacctgaaagtgacagggagaatggaaccaagttggaaaacactcttcaggatattattcaggacttcctcaacctagcaaagcaggccaacattcaaattcaggaaatacagagaacaccacaaagatagtcctcgagaaaagcatccccaagacacataattgtcagattcaccaaggttgaaatgaaggaaaaaatgttaagggcagccagagagaaaggttgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagacataaaattctttacagacaagcaaatgctgagagattttgtcaccaccaggcctgccctaaaagagctcctgaaggaagcactaaacatggaaaggaacaactggtaccagccactgcaaaaacatgccaaattataaagaccgtcgatgctaggaagaaactgcatcaactaatgggcaaaataaccagctaacaccataatgacaagatcaaattaacacataacaatattaaccttaaatgtaaatgggctaaatgccccaattaaaagacacagactggcaaattggataaagagtcaaggcccatcagtgtgctgtattcaggagacccatctcacgtgcagagacacacataggctcaaaataaagggatgcaggaagatctaccaagcaaacagaaagcaaaaaaaaagcaggggttgcaatcctagtctctgataaaacagactttaaaccaacaaagatcaaaagagacaaagaaggccattacataatggtaaagggatcaattcaacaagaagagctaactatcctaaatatacatgcacccaatacaggagcacccagattcataaagcaagtccttagagacctacaaagagacttagactcccacacaataataatgggagactttaacactccactgtcaatattagacagatcaacgagacagaaggttaacaaggttatccaggacttgaactcagctctgcactaagccgacctaatagacatctacagaactctccaccccaaatcaacagaatatacattcttctcagcaccacattgcacttattccaaaattggccacatagttggaagtaaagcactcctcagcaaatgtaaaagaacagaaattataacaaactgtctctcagaccacagtgaaatcaaattcaaactgaggattaagaaactcactcaaaaccgcacaactacatggaaactgaacaacctgctcctgaatgactactgggtaaacaacaaaatgaaggcagaaataaagatgttctttgaaaccaacgaaaacaaagacacaatgtaccagaatttctgggacacatttaaagcagtatgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagctagagacacaaaaaacccttacaaaaatcgatgattccagaagctggtttttttaaaagatcaacaaaactgatagaccgctagcaagcctaataaagaagaaaagagagaagaaccaaatagatgcaataaaaaatgatagaggggctatcaccactgatcccacagaaatacaaactaccatcagagaatactataaacacctctatgcaaataaattagaaaatctagaagaaatggataaattcctggacacatacaccctcccaagactaaaccaggaagaagttgaatacctgaatagaccaataacagggtctgaaattgaggcaataattaatagcctaccaaccaaaaaaagtccaggaccagacggattcacagccgaattctaccagaggtacaaagagctggtaccattccttctgaaactattccaatcaatagaaaaagagggaatcttccctaactcattttatgaggccagcatcatcctgataccaaagcatggcagacacacaacaaaaaaagagaattttagaccaatatccctgatgaacatctatgtgaaaatcctcagtaaaatactggcaaaccaaatccagcagcacatcaaaaagcttatccaccaagatcaagtgggcttcatccctggcatgcaaggctggttcaacatacgcaaattaataaacataatccatcacataaacagaaccaaagacaaaaaccacatgattatttcaatagatgcagaaaaggccttcaacaaaattcaacagctcttcatgctaaaaactctcaataaactaggtataaatggaatgtatctcaaaataatgagctaattatgacaaacccacagccaatatcatactgaatgggcaaaaactggaagcattccctttgaaaactggcacaagacagggatgccctctctcaccgctcctattcaacatagtgttggaagttctggctagggcaatcaggcaagagaaagaaataaagtgtacttaattaggaaaagaggaagtcaaattgtccctgcttgcagatgacatgattgtatatttagaaaaccccattgtctcagcccaaaatctccttaagttgataagcaacttcagcaaagtctcgggatacaaaatcaaaatgcaaaaatcacaagcattcctatacaccaagaatagacagagagccaagtcatgagtgaactcccattcacaattgctacaaagagaataaaatacctgggaattcaacttacaagggatgtgaaggatctcttcaaggagaaccacaaatcactgctcaatgaaataaaagaggactcaaacaaatggaagaacattccatgctcatggataggaagaatcaatatcgtgaaaatgaccatgctgcccatggtaatttatagattcaatgccatccccatcaagctaccaatgactttcttcacagaattggaaaaaactactttaaagtttatatggaatcaaaaaagagcccacattgccaagacaatcctaagcaaaaagaacaaacctggaggcatcatgctacctgacttcaaactatactacaaggctacagtaaccaaaacagcatggtactggtatcaaaacagagatatagaccaatggaacagaacagaggcctcagaaagaacaccacacatctataaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaactctagaagaaaatctaggcaataccattcaggacataggcatgggcacagacttcatgactaaaacaccaaaagcaatggcaacaaaagccaaaatagacaaatgggatctaactaaactaaagagcttctgcacagcaaaagaaactaccatcagagtgaacaggcaacctacagaatgggagagaatttttgcaatctacccatctgataaaaggctgttatccagaatctacaaagaacttaaacaaattttcaagaaaaaatcaaagaaccccatcaaaaagtgggcaaaggatatgaacagacacttttcaaaagaagacatttatgcagccaacgacacatgaaaaaatgcttatcatcactagtcatcagagaaatgcaaatcaaaatcacaatgagataccatctcacaaccagttagaatggcaatcaataaaaagtcaggaaacaacagatgctagagaggatgtggagaaatagaaacacttttacactgttggtgggactgtaaactagttcaactgttgtggaagacagtgtggcgattcctcaaggatctagaactagaaataccatttgaaccagtgatcccattactgggtatatacccaaaggattacaaatcatgctactataaagacacatgcacatgtatgtttattgtggcactattcacaatagcaaagacttggaaccaacccaaatgtccatcaatgatagactggattaagaagatgtggcacatatacaccatggaatactatgcagccataaaaaaggatgagttcatgtcctttgtagggacatggatgaagctggaaaccatcattctgagcaaactatcacaaggacagaaaaccaaacaccgtatattctcacccataggtgggaattgaacagtgagaacacttggacacagggcggggaacattgcacaccggggcctgtcatggagtgagggcgtgggggacggatagcattagcagaaatacctaatgtaaatgacgagttaatcggtgcagcaaaccaacatggcacatgtatacatatgtaacaaacctgcatgttgtgcacatgtaccctagaacttaaagtataataataaaataaaaaataaaataaataaatctttgtgaagttataaactttaattttatttggtaggtatctagaagtggaattactgagtcatagggtaagggtataataaattaaaaacaaaaacaaagaaaacttgtaaaatgttttctgaattggctatttcattttacatttctatcgtcaatgtgtgaggttccagttttttcacatcctctccaatacttggtcttttttaataatcatcattctggcaaatgtgtagtgtcatctcattgtggtttttaaattttgtttctctaataactaatgatattgaacatcttttgtttgcttattggttattcctatatgatctctgatgacatacctattcgaaccctttattcattttaattggatggtttgtgtttttatttagttttaactgtcccttatcagatacatgactttcaaaaatttctccctgctttatgatttgtcttctcattttcttaacaggtgactttgaagataaaccattttttattttgatgacgtccgatttttcaatttatcttttatgaattatgcttttcctgttacttctaagaaacaactaagccaaagtcataattttttttctgtcttcttctagaaatttcatagtttttgctcttatatttggtgtatgccatgttctgagttaatttgggggtatggtgtgaggtaatgatccaacatcattattaatagtatttttgcatagtttaatttctgtactatttgttgaaaataatattatttcatcattaaactgactttacaccatattcaaaaatgagttaaccatagtggatgggtttatttctgatgtttgtcttctatgttcttttttttttttttagcattacaaaatattttatatttaatgagaaaaaagaagcttgcaggcagcacatgaagcattcacagcaggtatatgattgaaaactagtaaaataagtgtaagttgttgactgatgtaggtactaatagcatctgactttcagcactggccttgattacacaggagatggagaagtcgttacaattaagaaaacatatttaacaaatcattgtcaatttttataatgtttcaagcccattctttgttgatagcctccacatttatatggttaagtcattgttgctgtgtttcttatctatgacattatttttatatcccttcatttgtggatcttaagatgttgcagaaggttcattcctgtaccccaatacagattcacttcctttagctgccttttctagcaccaatatgcttttaaaaaaatgcgaaaacaacaagcagtgacagcagccaattcctcgaatgtccagattaataactgtagcatgctaaagaaaggtgtgtgtaaatagctggagatggtatatggtccagagtccagcataaaattatttcctttctgagcattccctccattcccctaacccaaatacatgcaagaatgcagcaaaacccttcagaaacttctcttagctaactgcaaacttatctgttgccacaagtgcaaaggggtatgatgtgaaccagtatatcacaaagctctttagccacttcagttggtgacagaacacaaaaggaaaaaattcctacgtatacacaccagtctgtctccactttttataaaactggaataaaatgggaaagtgccatctttattaatcctaattgaattttaaatgtccttttgacacaaaaaggtatatacatgacacagctacacaaccttttttcaactggacaacaagtgtcaaaaccctgtggatgtatagggtaaaacaagattggtcacgaaaagagaattgtttctataactggtaatctgacacaatgtcctattgccattaaaaaaaaaggtcccttttcagtttattcaagtttgttttcatggtgttttatccctcttgataaaaaaaaattcagacttttgtaatttgtgtatgctgatcttcatcaaaaggttcattctctggatcagagtcagtggtgtcagaatatctataatgatcaggttcattgtcactaacatctggtgttacagaagttgaactgctagcctctggatttgacggctcctctactgtttttgtgaagtacagcttcaccttaaaatttggagaaaagtatcggttggctttgtctttatttgctttgtcaagatcattttttgttaaagtaagtactagatactccttgtcattatctgcacgctctatactgcaaatgctatcaatttcttgatcacatagacttccattttctactttttctgaggtttcctctggtcctggtatgaagaatgtatttacccaaaagtgaaacattttgtccttttttagcatcttgttctgtttgtggaagaactctactttgatatcaccacacacaggtaacggctgagggaactcaaaatacatgaacttgtcctcccatcgtgtgggtcctgaattggaggaatacatcttcacctttagctggcagaccacaaactgaggattgcaagttccgccactgaacattggaatagtttcaaacatcatcttgtgaaacaacagtgccactggtctataatccacatgattctttaccaggtagctatagtaatacacatagcgcctctgactgggaatagttactccctttttgtctctggtccttacttccccatagaaatctagggcctcttgtgcctttaaaaatttgccccgatgtaataaatatgcataaatcattataccagttcgtccctttccagctttacagtgaattgctgcaacatgattgtcatcttcacttagccattggtcaagatcttcacaaaagggtttgataagttctagctgtggtgggttatggtcttcaaaaggatattgcgcaactctgtaattagatttggcggtgtcataatgtctttcagcacaaagattgtgtatcttgtaatggtttttatgctttgaatccaaaaaccttactacatcatcaatattgttcctgtatacgccttcaagtctttctgcaggaaatcccatagcaataatgtttagataaatataggtcaagtctaagtcgaatccatcctcttgatatctccttttgtttctgctaacgatctctttgatgatggctgtcctgtctgggagcctgtggctgaagaaaaaggaggagagagatggcagaagctgctggtggcggggctctgcaggatggaaatggctctggacttggcggtagctgatgcccctcgctcagccgctgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggccgccgccgccgccgccgtctctgtctctcatctccctcgcctgagcccggcctcgcctcacagcggctcaacattcaaacttccatcacggctgcagcttctgagaggagagcatcttctaggttcgtaatctatgttgatcttatgttaataccacactctgttgattattgcagctttatcgtatgttttaaaattggctagtgtaagtcttttaattgtgtttttctttttcaaaattgccttgactattcaagtcctaggtatcaccatataggtttaggatcagctagtcaatctctacaaaaggtactactagaattttgacaaggattgccgtgtacttattgataaatttggagataatttctatcttaacaatactgagtcctccatgatcatggaatgttttttccattctttttcatcttttaaaacttatctcagcattttatattttttctatgtataggtcttatatttctgttgtttaatatattgcaaagtgctattttctatactgcaactataaaaatatttttcttaatttcacttttggattattactagtattagaacacatatgatttttgttatacatactgtatcctgacatcttgctaaatggatttgttagttatagaagtttcttcgtagatttcacaggagttttgtttttgtttttgtttttcttacatacaggatcatgtagtcggagattaaaaagagttctactttttcctttccaacctggaagccttttattgcaatttcttatctgactgtactgtctgatatctccagtgcaaggttgaataaaagtagtgaaaacagacattgttactttgctaccaaaattataggcaaagcattcagtcttttgaagctttcatgtttaaggtgagtgttttttcatgccgttaatcaggatgagaaagttcagtctgttcataatttgttgagattttattatgattgggtacaggttattttgtcaaatttattttattgcatacactgagataatatgatatgttttttattctattaatatggtatattacgttagttgattttggatgtcaagccaatcttccactggcaggataaatcccacttggtcatagtatataatcgttttatatattgctaaatgaggtttgctaatattttatggagaccatagacatactagtttgtagttttcttgtgatttcttttattagtatcaaagtaattctgacctgttaggctgaattaggaaattgtggactgaactgggatgaatttaggaataatcttattctttattttgtgaaagtttttttttttgtaggagtggtattattatttaaatatctgatgggatttaccagtaaagtcagctagtcctgagcttttctctatgacatggagtgataaactattgctcacatgttaaagtcaagccatggcctatatttgtatgactcataaataaactaagaataaattttatacttttaaagtgttagaagacggaagaggaggaataggagaaaaagaactgacagaggttgcatatggcccaaaatatttactacctagctccttacagaaaaattttgctgacctcttctctgtatggtgttatttactaaaatacttctttacttgtaatatgtctatccagacatgtggctttttttctcagttactcttatgtctttctaggaatatgtctgcttcatccaagttgtcaaattcattgacatagtgttgttcataacatttccatatgtttctatagggttactaattgtattcttcattttcactcctgactttgcaatttctattttcttgctttttatcttgttcagtctgactaaagtgttatcaattttatagcgtttcaagtaaccaggttgtagttccattgattttctctattgtttttctattctctattgaattgatttttaatttgatctttattatttcttccttatgtttacttttggttgacttttatttttccagtgtcttcaggtagaagtttagattatgatggaaacttttgtggttgttttcctaatgtagttatttaaagctatacatttccctttaattatggctgcgttccatgtacatcgatatatttttggttttttagttaaaagcataattactctagaaattccttctgaagcccacaagttatttaggagtgtgatgtgtttaattttcaaatatttgtgatttttccagcttctttctgttgtttatttctaattaaatccctctgtgatgagagaatatactttgaattattttaatcctcttatctgtacgttattatataatatataatctatatggggaaatactctatgagcacttgaaaaaccgtacattctgctgttgctgaatacagtgttgtaaaatcatcaattaagtcaaatagttttgtagtgtttttcaggtcacttttacccttatttactttctgtctagttggtgtgatcaatttttcagactggaggatttaagtcaccaactataattttgatatgtttatttttgtttcatttctgtcatttttactttatgtattttgggactctgttgttaggctccaggacttactccacagtgctgtacaggcacatggtttctacactaaaagtaactaaacttagagatttgtgggataccatcaagtatacccacatgtgtaaaattggagtctcagaaagagagaagggagagaaagataaagaaaaaataatggccacaaacttctcaaagttgtgaaaaagattaatcaaaagaacctagaagcttaacatctctcaaacacagtaaacacaaagatatctatgtctagatacattatagttaaacctcagaaagccaaaatccacaaataatatactgaaatcaatatttgttctcaacaagagaaaaatgactcatcatgtgaaagagaagagtaatacaattaacctgactttaaatcacaaacaatggagatcagaagataatggagaggcactgaaagaaaaaaaaaattccacccaaaattctctatccagcaaaactatcctctacaaatgaaaatgaaataaagacatgcccagataagcaaaagctacagaattttgtggttagcagacctgtcttacaagaaatattaaaggaagtcatcaggctgagagaaaatgacattgttagtaactaaaatccatagtaagaaattaagagcaccttaaaggataaacatatgtgtgaataaatataaaaaatacatacacacatataaacacacatagaaggaatatatattttgtatatgtttttatagcatttaatatacatcaatctgggtgggcacaatctaatcagctgccagcatggctagaataaaagtagaagaatgtggaaggactagactggctaaatcttctggccttcatctttctcccatgctggatgcttcctgctctcaaacattggattccaagttcttcagtttttggactcttggacttaaaccagtgatttgccaggggctcttggaccttcggccacagactgaaggctgcactgtcaacttccctacttttgatgttttgggactcagactggcttcctggctcctcagcttgcagaagacctattgtgggactttaccttgtgtttgtgtgagtaaatactctctaataaactcctcttcatctatcttattagttctgtccctttagagaacccagaatgtaaattagtacagccattttgacaaacagtatggaggttcctcagaaaattaaaaatagaactaccatataatctagcaattccagttctagatataaattcaaaggatatgaaatctgtatgttgaagaaatatattcactcttatattccttgaagcattattcacacagccaaaatacagaattaacctaggtttccaccaatggatgactagatgaagaatatatgacttatattctgtatatgtatatatatattctctatatgtatatgtatatacatacacacacacacacacaaaaaaaatggaatactactcagccatacagaaaaaggaaatcatataatttgcaacaacatggagacattatgctaagtgaaataatccaggcacagaaagacaaataatgcatggtctcacttattcatggaatccaacaaagtcaaacccacagaagcagagagtagaagggtaattgccaagcactgggatgtggtttgaggaagggaggcatgggaaatagggaaatgttggtcaaaggtacatgttttaatcagaaataagttcaagagatctattatgcagcgtgattactatagttaataatatatttactcttgaaaattgctaagaatgtagattttaaatgttcctaccaaaagaagtcaaaaccaaatggtaagtatgtgaggtaatgcatatgttaattagcttgatttaattattccacaatgtatacatatatcaaaatgtcacaatatcacattgtataccataaatatatataatttgtatttgtcaattttaaataagtaaataaagtaatgagatagctttcaactaagcttatatagtggtataatataaaaatttttgtagtaacaaaattatagtaattttggcttatactgaaatgtgcattaaacaagtgtttgcataaaatttcaattcaaattactgttcacagcccacagaaagccacgaaaacgtgatttactcttggtatggaaacaaatagcttgtactcctaaggaaaaaagaaaattcctgccttttgatgagaattgtttgagttttatacttactttatggggagctttgctgacctcttcattccacgatagctggatattcctcccctgcatgtacttttgtttcctgggggcagtgagtcttggaaacatttgtgaaattcttattctgagtttgcctggccacagcccaggttccttcacggacacttcagcatcaggctctctcctcagctttctttctatcttctgtgccctctgctcataaaccccagctcatagaagctgaagtcacctagactccaagacacctgattgtagagacaggaaaggagttctcaggatatgtgccataatttcatactggtttctacaagaatcagggttggaattagagctgattcattattcagttaacattgacattgttgattagagacatatccctgttgaaaatatttcccggcaaaaaacagaagttccctttggctctgaaatctgcaaagccctttcagatgtccctgtgtccttgtgccgtcactccacagcactgcacaggcatgtgctcacctcacaaaatggcagtctcaaagggaggagtgtccaaccacaagaggcgccaccctatgctgagaaagaacctttcacaggaggagagaaaagacctttccagaatctttaacataagattttttgtgtgtgtgaagtctgacctgagcagcaaccttgcatcagacttcaaaaggcaatatttcctgtacctccttgtgctgtacaagtgagtacagaagtcgagaaaatgttcctaagtctatggccagttcaaattccatcattttctatttctgagattaaattatatgtattaagatccttactctgccctttcatgtttattgctcctcggacaagatatcccctcttcaggtcccaaacacattcattgcaatgcctttcctcatccttgtcccagtcctggctctctagcttcttgagacaataacccatcctaaggtatgtggtgacatgcatcttctgcctcactgggatccctaagtggtataagcattcactcaattgctttagctagagtccccagaatatcttcaccctctgctgtcacactcttcttccacattggtccataaccacatctttaacatttctgtttattaaaacctctcaaattcaaccactattttctatcccaaccaatactgccttagctcaggcaaccactgtctttcacctgaattccttcaacactttccaaatatccacctacctgatgtcttactctctgttctaactcagttcattctctgcagctgaaaacacttcctttccattgactttagggttatgaccagtcttctttatatctaaatgttagcctgtaagttctttttgtaaaataaataaataaataaaaatcttccaaactacaaattcttaaaaccctccatgatttggcccttgcatacctatccagtcttgtgaaattcacctactctttacccactttttgcatacttatgctctaataatattcataatcccttagctccatatgtactttcttactcactcctgagcctttacatatgctgttcacagtacttagaataatctttctctccctatttatctgtactactaatccttcccgtttaggcctgagtctttaactgtggtaaataccccatggtatccagagcttctacaatcatagagtatcacacacttcattgcttaacttattatgatagttttaaaaattattaatacaaaatatgctcaatgaggccaagaccatgtccaaggtttaatttttgtatcttcaacagtattacaggctctgaataaagtaggcgctctataaatatttattgaacaaaccagggttttatcagttcttgcctctctagctaagatatgatctcagctatctaaacatttctctctcaaaagtattgctgcaattatttagagattttcacattgtggtagactgaagaataatctcccaaaatgatcagatctgaatccttgaaaattatgaatatgttcgcttacattgctgaaaggattttgcagatgtgattaagttaaggatcttgaaatggggaggttttccttggttagctgagtgggcccaatatcgtcacacactttcctaaaatatcttaccaaaaccacaccacctctgtgaagccctctctcttttcccagacagatatggaggtttctttctttacgtgtttataacaaattaaagaaacttcaacttctatcactatgttatgatatttatggtcatgtctgactcttcctagactagaatggtttttgagggattggactatatgttcatttacctttgtaaatccagtatgtaggacttggtacaatatattggatacagaattataagcccgataggagcagaaaactttgttgctcatccttgtatcccagaatctagtactatgtccgatgagtgtagtaagagtgaggcaagaggatgcaagtcagaaaaaggctatgtgacaacagaagtagagatcagaatgacagacactttgaagatggaggaagggccctgagcccagtagtgcagatggcacctagaagctggaaaaggcaaagaaatggattctcccataaagcctacaaaaggaacaccacctgccaacaccttgatttttagccccaaagacttatttcagacttttatcctgaacaggacagaagcaaaaaaatggaattgatcaacataaaagcagaagttaataaggtagaaaattttgtaatgatagaactaagaaataagcaaatgagatcattgtttgccagccaaaagacagagaggacaaatatactaaaacagaagtgacaaggggaagtatgataaagtctatttttaaaaacaatattttgtataattctctgcaaacaacctaaaagcctaaatgaaatggctcacattataaatttaacaaaactgaccctaatgtggataaaaagcctaaacaaaacaatgactacaaaagaaataaataaatttgtaatagaatttcctcacagaaaagcgccagtcccatatagtttcttacagggatttttccacaccttttaaaatcagggactttgagaatacctaaaacattgcaaagtatagaaaagtaggggaaatttctaaattattttcatgacatgaccttaatatttataacaaaactcaacaaaactgcaccttaaaaaaaaatctatagaccggccaggcgtggtggctcccatctgtaatcccaacactttgggaggccaagggggggcggatcatgaggtcatgagatcaagaccatcctggctaacacagtgaaaccccatctctactaaaaatacaaaaaattagccaggcgtggcagcacgtgcctgtagtcccagctactcgggaggctgaggcaggagaatcgcttgaacccgggaggcagaggtttcagtgagccaagatcgtgccactgcactcaagcctgggcaacagagcaagactccaactcaaaaaaaaaaaaaatctatagacttacatcactgattagtattgataaaaaaaagtattcgataatagtgaatcaaataatgacattagaaaataacctacaaattggcgtttgctccaggatggtaagggtagttcaacattagtaaacttactcatcaaatccattatattagtcaatggggttggcctgagcactgggaaaggggtgggtagaaaatactgtctcagaaaggcattgagagagaacacatactaatcctatctggaaatttacgctcctcttcagccattcccgtctcttaaggatactctccagctttactgaactctttgcaaactccaaaaatatcatattctcttagatgttgcataggctggtcccccagcctagtctaccaggaaattattcattttcctacaaatcttacttaaacccacactacctctgtgaagtcctttcttcccagggagatatggaggtttattttcctatgtgtttacaacaatttaaagtctgttactgtattatggctttttggtcgtgtctgactccttctaggcaagtatggtctttgaaagatgggaccgtaaatctttttacctttgtaactgcagtagtaggactaggaatgatatatagaatacagaattataagtccccatgggagaacagaccttctttttgttgttcatgcttgtatcccagagtctagtactatggtgcacatagatgtatatttactcaataatatgaaagacccaaatatgcctttatggaattgaccctgcagttacacctcaccatctcctacttaccccagaattatttattaactatctcatgtcttaggtctcaacccccttccctagttaagagggggccctgttgctaagcaggttaaaataggaggctgatgaagaaaatctctgtggaaaatactgaagaggaacacaggaataaaaatacctctactctgatgatgccttatataaaggcagatgcagttggcttaaacttctacattggctcatttctatgaatgccacacctctcaacttcagggacttccagtgaggtgcttcacaacaatctctggagtcagtgcagagctactcccttggcgaatctcttcactgacactcaatgggccatcagggtgggacttcgcctctgctaagccacaggaatacactaaatcctgctcctgagaggaagggaaagacaaaggatcataggaagtaaaccccttgaggaaatttcaatttggaatttattctatttataacaaggctcgagtagcatatttattttccccatctcagaccctaacctcaagtgaacttactcccagattcacacacataaacatatgcaccagcaccatctcagcaaggaggcagctgcaacaaaaagcagcaggtgggagaatattatgttacatattaaactacaggattactccaagaattacattccctaaaattattccctccattggaagcagactgtagccaataggaagagaaattgctaaaacaaaaatgcgttcggttggatgaaatatttacctaaaacggaaatatatttaagaagacataattcttcagaattgtaaggtaaaaataaaatcctatacccaccaactgactgaaaggaccatttctgggacaagggcaccccagagtaaccttgaacattgagttcttggctaggacaggatggaggggtcagacacaccttattatacctctcccttggagctgtgatgacgttttcttccctaaaggctaaacacaaaccagccctttcaaaagactccatccctaaaagcaacagaaagtctgatgctgcccctcctttttgcctggtaagaggccaccaaccaaacggtgtttctggccagtctagggaggacatgtagtgaggcttttggtgtcctttgcttcaccttttgatgtcagagagctgaaaactccacccccagatcatgctaacatggccatttttttttacaggggtcccatgaaggagcaggaaactcaattgtggaagcacacgtttttccctttattaatgttcatgactcctcctataccttattgtatatctatatttggccattccactcagcatgtatttcttttccctttgcccctccctagacatgtctgtttctggcttcttgccagagctgtgcttcccagcctgtcagaatggccacactgcaggctgcaaccctttatgagaaataaagctctcccttccaaatttgaacttcctcattcttcagttgacaatatcatcattcttctaagaagatatcagtgaaatttcaaggatgattcagcacgataatgaaatgtttgtaatcattcaagatatactaaatgctgaaggaagtcagtttagaaataagaagtaggacaaccaaaggatagaacttagaagaggacaaataaaggattttacagaagccactcatgaaaagagatccaccaattctgagataaaagaactgggtttgagtaagccacttgttgtaagagtgctcatcaaggttttcagaaaaaaataaacagagctagtcaatgacacctggtaataaaagatattttgaatttcaggccatagagggtagcatgctaagtgcattttcagttttgggaattagagtaaaatgaaaataatttctgaagaagcctccagccaaactctaaaaagaaaaagttaaaaatgcaaggtatagaatatttgaaaaatttattattaatagttgaaagtacatattttagaactggactgatccagtcaccatctagttttgccatgttacttaacctctctaaaggtagtttcctagcctataaaatggaaatagtcacacatggctgtgagttttatttaattgagaaaatgtatgtaaactgcctgacacaatccctagcacaagaataagactcaatcataactaatggtggtagcagtaagagtgctactactagctgaccattctggaagttgagcctgagtgagtgattactatacactgtgcagttgtaacttcttaacacattaattcatttaatcttcacagcaaatccatgaggttcatacttttattagtacaatttacagagagtaaaactgaagcattcacagttaacttacttgcctaaaatgagcttaagtagcagaacccatatttaagcccaggcactatctctccagagccttctttgttagccactaaccttgtggtagtgctatcaagtaaatgggcttgctgtctgatatgctcagaagccaataaccatggcaccagcttttgaggaaagaaaggttttactgcaaaactggtcagcaaggagacatgagctggctcaaatctgtcttcctgatttggggtcttggacaagttttaagggactgagagaaaggatttagtaatactgggttgatagagtctgactggagggcttcagatttaaccatttatggtaaagtaggttgaggtagatttgagcccagatcttcccagccaatgaacccactgcttctcaaagagttttggcattcagattgcaggcatcttcctgtcttcttggttccgaagggaggaatcattcattccaggtgttgttcgagatcaaagcttttggctctgttgtacctacaagcaaactcaacattttgttatccacataatagacccagtttgggctgatcctacagttacaaattcttccctttttgtttagtttagtttagttctcaatcttgaaggaattgagtgtctaccactctagctactttttgttgacaagggacataggtctgggtttgaggaatgaaattgtttcataattaattgcaaatgttcatgggtcctgggttgaagtcaaacaggtgggtcagggaattattttgatatttaataattatttcatgagcagggggaattgatttaaaaagacaagatagacaacaggtagagaacttgagagaaggaagagaaatctcaacacatacagaaatataatttttagtttaagtagaccctcaaaaatagatcttattcctgatgaaaacatgtttacatattatatccaggtttgttagagaacactagatggagtcaagtggcttttggtctattattatttgggtctgtctcaacatttttagaagtattaatgtaaatacagcatgatgtattaaagcataaacacctctttgtttagctagtatataatctagggtaattttattatctagtattactttagccaaagcacctggctctctctgttgagccaccatggccattgtggtctccttggcaagctttttcagggcaatggaaaggtttttaatcatatgtttatgagaagcaactacccaccatggcaacagagtttgtctaaagaaatatcctataccatctggtgggccacctggtaaatatttacctgggaggaggtttagcatagatcttttggccattatgaacagttttatggtgttagtctaatgcctagcatcactaatgtcatagacagagaaaggagtgactaagtaccctagtaaacagatgtcttttgggcatcagctgtcaaggcattcatagtcccagggctggtcgtttgtttcatagacaaagacatatcctgaggaggcgcatagaataccagatatattaacatttaagttctcagtttgaggaattttacttaggacttggtgaaagtaggagccagagtatagaagagtctagaagaagttttctaacttacaaattggtagggaagagggcagtccctgaaggtatactaggttctttttatttaaatcttgacataatcatgtagatctacagtttgaggacacatcagtgtatctctcctggaccagaggatagaaaacaggaagtggatagtaggtgtgtcaagtaaacagatgacttctgtttctgagttagccaatgtctggcttctgtgggcataggcccctttatcctaacataagtgtctttgaaggggatgttaatgaaaaacagggaactaatgatcctccaccagcaaatctgacttatactgtgggtttttgatcataagtcaccagaaaattaggcactttagagaagctggtcacagagataagcagcagatcagtgtgatcaagtgcagaggagggtttttgatgacatctctaacatttagatagattttgtgaggtaggtagggattgggacatttttatcaagaaattatcttttttgccatgtgtggtggctcatgcctgtaatcccagcactttgggaggctgaggtgggtggatcacttgtggtcaggagtttgagaccagcctggccaacatggtaaaaccccatctctactaaaaatacaaaatttagccagatgtgttcacttgaactcaggaggcagaggttgcagtgagccgagatcgtgccactgcactctagcctgcacgacagagggaaactctgtctgaaaaagaaaaaagaaagaaagaaagaaagaaattatccttttatgttgaggttaaggcaagcaaaaggatataaaaggatataatagaggaaaactgtgggcattttaaacagaggaaatcattttgtttcactgagaggagatatttggctgatagaaagaaaaggatcagaaaaaaataaactctacccaaggaagggctataaggtcctaaatatatttttgaggttaaatcaaggaggtagaggtgattaattcaatagcgcagaataatatatatgacaacaaggtaaaaattaagttgcattaatacaggcctcacccaatatcttgggcaagctgtctcctttagttgtctcctgtttctgccctcgtagttctatcagatggaggctggttttagacacagaaatgattttcacttatctggagagtcaggagcccttttggtcttattgagttttttaaaaagtaacttaagatcatttaggggtttccaagtgtgttcctgggtggaaaaactggttgtgggcctccacagccatctagtatatggtcagtctggtcctttggtttttcttacctgtgaagggcatgacctgtttgggaattttacagggaccaagaggaatcttttgaaaatgggaataactcttacccatgaatgatgaatttagggcctcaacccttttaactttattgctgaatggatcactaaaggaacttcatagggcctaatctatttgaactgtagttggtcttcagggtggtgatttttctaggtcgtaagttgtactcagtttcctagacttagacaatgtaaagggaacatctataggaaacattaaaacagctagaagtgtaattatgtatagcagacaaagttatacccagagactgtacacattttatagcatctaatgcatttacccatcatgatgattttcaatgttaaaataatatttagtcataagaagggttgtcccacatagaattctgtaggggctaaactggtgcttgcttttaggggccattcttactctaagcagggcaagtggcaagaccttatcctatgttaaattgggtttttgacacattttggcaagtacattttataagatattgtttatcttttcagtctttctagtagactggagcctctaagagatgcttaatttccactgtatcctaagagctccataaacttcttaggtaagtctggtatttgttgtcactttgaattgaaatagacaatccgaagtaaggaattatgtcttttaataaagcttgagttacctcagatgcattttttgtttgacatggaaagaacttgacccgtctagtgaaggtgtctacaagtaccgacaggtatctatagtttcctccagctcctggcataactgcaaagtctatttgacaatcttgtcttgtttctcttcctcaggtttagacccctttgcctgctggaggtggtcctgtctttggattctctgtagcacaaataagacaattttggatagtcttttgtacgtgcagcctgacaataaacttcagtaactaatgataggttgtgtttcttctataatgagttctttgatataactgggaaataatcctttatcaaatgctcagggacaagaactattccttgttcactgtaaatctagacttctttagttattttatagtgttccctctccaagtcttgagtatgagtatgaaatccctactggtttgctctttctagatttacctttgagtactgggtttaaataaggacagattcatacttggaataagtaccagagcctttgttttaggctgttttatcctaactgtatgtttttctacctgatcagctagattattgcatttagttatctagctatcagtcttttggtgtcctgggcactgcattatggccattttttgacaggaaaattgagtctaataagtctaatatctctcttgtatgtttaattttattctttaagagattagtgaatctctgtcttttatatggctccatttacatgcactaccaaaaagacatatttggattctatataaatggttacctttttatttgtcctgaggtgtgaagctcgtgtgagggcaataagttctgccttttgggcagagatacctggtgggaaagcctcaggttttaagattttctggtaagtcactaggtgtttatctggcttttcagagaccctgatccatgaagctgttcacattggtaaacattcccaggtctgggtatttcaaaaactgatttgtcaagtcaagcctgtttttttagagcctcttttaggatttcaggtggtatctttcttctcattgtaataaggcaacttggagggtgcaggcttgtttaggagacactctaatattgattcattctggtgaaaaattacttgtgcatttaattttgttagcaagtcttatcccaacaaaggtattggacattcaggcatatataggaagctatgtttaaataggtttttcctctgtggcatttgagtggttgaaggaaaggcttgcaaggatgtttccccagatacaccagtaatagcagtggtctttgggaagatggggacttgtcttatgtttgggatagagtgtgtagctccatggtcaactagaaaatctatacatcacttttccacaccaactgtcatctgcacttctttgtgggaaatgttgacagagctaatagagtgtatagaagtccctgggtctcatcattactggttgctatcagtaagctgtggcatgtggtgtgttgatctgtgggaagttttatcttaaaagactatagacaagtatgttattaaagtttcccattttgtatagagttttatctgaaataactggaacaagctcctgtacaaacgaggtgttctcggtctgtggtgtggtgattatggggattcctcttcagagaatcaccaatgggctagatattccctcttacatgtctcagagggtcctaaacaccagatggtattgggccgctcgagatgttggggttaccaagatcccttatgtgctcctcctggatgagctgttgaagttctttctgacccaggaatgggggattggtttatcactttacatcgtaagccaatggcctcaacacctctgccaggctcttagtcacctaggaacaccctaaagggcaggaggaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccaaattgagtactctaacagttacagcaccttactattgcacttattctttcagaccctaacccaaagccaggactgaaataatctaaccaggacctccctagggtaggattcaaacccatgaagctacacaaaaataggactctaatctacactcctagaccaaagataatttaaggtgtaagcacatattaccaaggtactgactccaaaagacatcttatccagaagcaatttctttcctcaaaagagaaagtagcactcaaagggcctgaaatgtcatgacagagaataaggacctcacagctaagcctctggataaactggtctaggtagcaccactcagggtcagtgaagaaactttagttcccactgaggggctacagtgccttggcaggcattggcctcacattgggcacctatatttgttatcaagcaaatgggtttgcacacagaagccaataactatggcaccagcttttgagaaaagaaaaggctttgttgaaaaaccagtcagcaaaaagaaaggagtgagctcaaatctgtttccctgatttggggtctagggcaggttttaagggatcagagagcaagggaaaggatttaggaatgttgatttggtagggtctgattggagggcttcaaatatgactatctatggtaagatatgttgaggcacattttagcccaggagcttctgggccaatggacccctcactactgaaagaggtccggctttcaggttccagtcatgtcttggtcttcttgtttctaaggggaggaatctttggttctgggtattgttagaagtcaaagcttttactgttgcacatgccttggctacatgatttgcagttatgtagctgttggcagtgtgagagacaagcgttgtttctctggccaggaagtgaatgaaaagtgctggtatcagagactaaattaatcacagcaccaagcaacatcctgcttttggtgctgccatgagcaacaggcttctctgctgtgtgatcatttgtctcctaagagcaggtgagtcctgggcacaggtgaggaatccctattactgaattcacaggatctaactataaaatgtttcttcataaaagtcacattagtctcctctttcccaggctctgtctttatttgatcacccatttttcccaacaggcctcaaggatgctgtagttacacaattcccaagacacagaatcattgggacaggaaaggaattcattctactgtgtccccagaatatgaatcatgttgcaatgtactggtatcgacagaacccaggacttggactgaagctagtctattattcacctggcactgggagcattgaaaaaggagatgtctctgagaggtatcatgtttcttgaaatactatagcatcttttctcctgaccctgaagtctgctagcaccaaccagacatgtgtgtatctctgcgccagcagttcatccacagcactgcatagctgccacatcctctccacataaaaaaaggtgcataccaaagaggaaaagcctgccctcaaaattcctcaccgcaaataagagaagttacctcacaggtattgacaaaaagagccaaactctgtaaaatatttgaagagatttattctgagccaaacatgagtgagcatggccagaggcagaggctcaagggcctaagaacgtgtgtccaaggtggtcagcctacagcttggttttatacctttttggagacatcagacatcaatcaatacatgtaagctgtacattgtttcaatttggaaaggtgggacaactcaaagagggggcttccgggtcataggtggattcaaagatttttcagactggcagttggttgaaagagttaagttatcgtctaaagatttgaaatcaatataaagaagtatctgggttgtggggaccaaggttcttattatgcagatgaagcctccagggagcaggcttcagagagaatagattgtatttcttaatcaaacttttaaaaggtgccagactcataattctcttctggatcaggggaaaaacctgaaaaggaaagagaattatctacagaatgtagatttccctcatgatagacagctttgtagggccgtttaaaaatatgtcggaaaatacattttggggtaaaatattgatttttttcagggcctgctaggagtcatgttggtgtcttattgctacaaagggtctgttttgtcactcataaggtttccattgtaatgttaatgctggttggttgtgcctgaattctaaagtgaagagggtataatgaggcatgtctgaccccacttcccactaagaactgaactggtttttcatgttaactttggaatgctcttggccaagagaaggggtccacacagttggttgtggggcttaggattttatttttggttcacacaaaagtataccaatgtcctcccctaggtttgatatgccctgcttccctctttccatttttgtccttctaggacacctttttggttgttattaaacccttcatttcttgtcaatatcccactagactatagggcatcaacacaatatgaacacttgtcttggtttatttgtgctactatagcaaaataactgagattggataatttataaacatgaacttgtcacagttctgtaggctcagaagcccagaacaaagcacctcaggttcaatttctggtgagggccttggtctctgcttccaagatggcaccttgagtgctatgtcatcacatgagaaaagtgcctaagctggttccctacccttttatgagtcactaatccattcatgagagcagaaccctcatgacctaatcacttcccacctcttaatactgccacaatggggattacatttcaaaatgaattttagaagaaacacattcaaaccacagcacatttctagacaaactttcagacacagatgtagagaaattttaatgaaattgaattttaaccaagtgaagacaacccacagatttgcaaatacccttctaagattcttcaaagatatctcaatggttaatcacgttgtttaggaaaatgagaacagtgacagcaagaccttctcagtggtacaatggcctcagcagcagtaaaagagggtagtaaacattatgcagactttgtgtgggctctggatcacccacagagaagaaagttattttgtatgtatgtgtgtaactgtatgtttaagagaaatgaactgtttatttacagggattattgaggagcagaacctcacttgggtagatgcaggtgtaacttttaagatcaatatccatggctttgaatagataggctagagatacagcagatttacttagttccccaaagatgcatgttgggtgatacccacctatattagttttccaattactgcaaattcagtaggttaaagtaacaattgtcttatctcacagttctgtatgtctgaagtccaggaaagtatggctggatttttctcagggtcttataaggtggaaatcaaggggtcagctgtctgcattttcatcaggagattggctactcctcctagattattcctagtactggtagaatttggttccttgtgacagcaggtctagggtctccattttttattggctgtcagctccttgcagtttctttctggtccccttgatcttcaaatgcacatcaaatctgtctcatgtttaaaatcctgtgatacccacttctgcttcaagacagaaaactctgcatttaaagggctctggtgattaggttaggccaacctgaatagtatttattttgtcaaataatgtaacataatcgctggagtgacatatcatatttttaggttccactcatgctgaaagtgaaggacattatacatgggcatgagtcactggaggtcattcttggaattctgcctaccataccaatggagatcaaatgccaggaaagtcaggaatagaaattcagagagcatacaatcaaatatattaaattagaattcaaaactattcaagagatggttcagagttttggccaagcagtggatcaaattttcttactactgcttaatcaaggatacagtacagaagtaaaatgaattgatctttattaaaatggagcaaagaccaggtctaggaaggaaaggcaagaaggtggaatagatttgctcttactggaagaacactggagattcaagacaagaaacagaattgttttagtccctgagttaacaaataaaagaaagatgagaccagaacagttgtcaatgaaggagcagtgaagtagaaaggaaggatggagtgaatgtggagagcacttttctgaagagaataaacttagttgtcagatgaaaggagatttataattagctttgtccttacaaattttgaggtaacttaccatggaaatactttttcttatcagttgattaatctggggggaggtagcataatcctttgaaattccagtgcgtagaaaactaggctcgacctcaagatgaagcctcaaaaaagaaatgtctgttagaatccagttaacaggagaacacctactgcgactttattatcagcaagttggtgaaaacttcctgaagaagaaatgtgggatgatacagaaactgattaaagtctcagaacagcaaatagtttctcctcttgtgaattaattcaccttccacaattaaacagagataactcagggtacctcaaatactgatgagcttgacagaaatgaattgccacctaattccattgatggagaaagataagacaatgagcaaagaaaagggactttcagagagaagaattgttgagaaggtagcagtcctttctctttccatgaggtagttgctattcattactctgtgatggggactgggaacacaagaatcaccacttagggattaatgaattcaagatctgtaccttccattttgatccaaatttgaacttaaatttattcaggacaccaactgaatacttctacctaaaggtaaaactcatatcatatttccctcccaagctgcatttcctctgagttcctgacttgacggagtcatttatttgtacaatatatgaacgctgagagttgtgccacatttctctctcttttgccctggacatccaatttttatgcaacactttcatttctaactcctaaatatcttagtttactatctcaatcactgcaaccactgacatgtttatgccctttttactagcttgccaaataaatataaaagagctcattaatctctctagttccttattaatcctcatttcatctaatctagtattagtattatacccaagtataatcttccaaattgcaaaaatctgtttctatcactctttctgcagcatccttcactggctcccccatggtctacaatatatacaatctaagttttaaaaagaaaaaaacttatgactatcccttattttgaaaaaaggaaaattagtcctttactagaaaaatagcactgtattataatgtcaagttcacactagagtctacgatggtgtcaaagagctctatatttttcttcttgagtcactttgatatcctcccacagtaagaccattacagttggtgtattggtctgttctcacactgctatgaagaaatacctgaggctgtgtaatttataaagcaaagagggttaattggttcacagttccacattgctggggaggcctcagaaaacttacaatcatggtggaaggcaaaagagaggcaggcaccttcttcacagggtggcaggatggagtgagtgccagcaggggaaatgccagatgcttgtaaaaccatcagatctcgtgagactcactcattatcatgagaacagcatgggggaaactgctcccatgatttaattacctacacctggtgccacccttgacacgtgtggattatagagattataattcaaggtaagatttagatggggacacagagccaaaccatatcagttgggtactgagaaggacatactgtattaatcatgccttcttattgtctgtattttctaatgttttgacatccatattttctgatgttttgacatctggggacttgctgatcttggagggactgaccctctcagggttaactcattcctaggggtagcaaactgctttccctagagcatgcctttcatatcaaatcaaccaatccaaacctctactccaacccaccttctttattgggctctcatactctgagcccctattctcctaccctaattaccacagggccaggtactaaacaacttgagataatccctacactttgtagcctgctcaaaaatttaaaccagccaatgctaaacctatttagcctgtgtaccctgcctcactcatttgttcagtgaaaaccacaataaagtttcttgccaatgtttcctgtcactccttctatcttctgacccactgttgtgattcttattgctatgatttttttctaacttggtcatgaggtctctctttttagactagccataaaccaatatagccactctctaggagacctctgactcaggggagggggagttagattcaggtgtgagtgtcaggtgagacacagtggaggaagtgaaaacaaaatgcatgaaaggaagaaatttattactcacagaacccaaagaggttagagaggcccaagagaagtgtgaagatggcacggagctcatccagttgaggagggaagagagggcacaggcaagggcaagagggggtgggtgagggccggtggaactattccttaggctttcctatgggggttatgggtcagctactttaaatgtttcagaaggaggaaacttacttgcaggactctagcattggccattaggctttatcatggtcagcagctctggagtgtgttgggttttgggtcaggggaatgagaaacagaccatatagctgacaaccacacagggagaagttttaactgggtcaaagatgacagagtatgactgggtttcaaataatttgtttcaggccttaaaaaaaaattggggccaggcacagtggctcacatctgtaatcccagcactttaggaggctgaggcaggtggatcactttgaggtcaggagttctagaccaggctgatcaacatgaagaaatctctactaaaaatacaaaaattggccaggcatggtggtgcacacctgtaatcccagctacttggaaggctgagacaggagaattgcttgaatctgggagacagaggttgcagtgacccaagatcatgccactacactccagcctgggcgacaaagcgagactccatctcaagaaaaacaaacaaacaaaaaaactgggcctgtgtggccctgcatagtgtgtcatgccccttcttcttgggaactgtaagtaacaaactgtattttcagtggcagctgtctcctgatccattagctctaccatacctgaataataatagcactcatattctaaaacacttgcttcttatgagtaggaagaatgggtcagtgcttcagaatcccagacatgtccaaaggaagaggtgaagaaaaccaaatgaccagatcatacccagcctgattgaaacacacacaatataatcacccctttgtctctatgtgttcaccaactctgcaagtacacctgtgtatagtatgctgacaagctctgtcttcttcaatctgctaaatcgttttctactttcctacattgctgtgggccaggagagccctggatgtaatggaaagtggggaggggttaaatccgtctaggaaggagatggatgggtaaaaaaaaattgtgtaacatatacaaaggtttctatgattacaagcctactatgaaatccagtcacacctaccactcacagtcccacttactttgctctaagcaacactgatctccaaacatgctgtgcatagtatttcccttacacggcacacctgcaaatttattctgcactttcaaatataacttaaaacaatagcactacatgaaatgtgccattttcccaagaagattgtagactctttcccctgtactcgccataccttacacaattctccctttctgcaaataccaaattatgtttcttggtatagtgatcttcccatgggcctacaaaatccatgtggtcaaatgacatgcctttccgttattccttccctagaatcttctcctatgcctgacatccatgtttaatgaatgatcagacacaatataggaagagggatgctgacttttatgtttatgcctctattctcaggatctgaaacagcacctgatatttaacaggtgttcactatgtgtctgttaaagaaaaaaaaaaaacattaatgtctacaatgatttgatcctgggtttgcctcttctctccttcttcctccaaagtatattccttaaatttaacaacccttgccttccttttctgtctaagggctactggtaggtaggataatgactccaaaagctgtctatgtcctaaacctcagaacctgtaaatatgttaccatacataatagaagataattaagtttgtagatagtttagtgtgctaattagctaaccttgaggcaggaagattatcctgacttatgcaggtgggctcagtgtaaacacataggtactcagaagtgactatggtgagagtgatgtgagaactttacctgctgttgccacctgaagataatgaaaggggccatgagtcaaggaatatgggaggcctctagaagctagaagagaaaaaaaaaaaacaaaacaaaaacatattctctcctagagcctccaaagagcaaagtgccaatgagacccatcctggacttctaaccaaaagaattgtaagataataagtttgtgttgtttttaagccactaagtttgcagtaatacggtacagcagtaagagaaaactattataaggctctatttcgaagcagctgaaaaaaggcagctgatgaaggaagtcgcgctgggaagtagcctaagaggcaaaagtacaaagacaggagtttgaatcagatgatgccacttttaagggtggatttgtcagagacatatgaaccagagcaactccatcttaagtaggagctgggtaaaataaggttgaaacctactgggctgcattcccagatagttaaggcattctaagtcacaggatgagataggaggtcagcacaagatacaggtcgtaaagaccctgctgatgaaacaggttgcaggaaagaagccagccaaaacccactgaaaccaaaatagtcacaacagtgacctctggtcatcctccctgctacattcccaccagtgctgtgacagtttaccaatgccgtgacatcaggaagttaccctatatggtctaaaagggggaagcatgaataatccatcctttgtttagcatataaacaggatataaccgtaaaaataggcaacaagcagccctcacggctactctatctatagagaagccattcttttattcctttattttccaaataaacttgctttcactttatgctatggactccccttgaattctttcttgcttgagattcaagaatcctcttttggggtctggataagaagcctttcctgtaacagctttctggtgattatgaagagaccgtagtgaggaaaccccggaaccaaaggataactttgggtaagtgttggggtcgtgtaacatcttcctggcaaaccctgaagggatgatactaaggagacctccccccaacccaaggaaatagactgcagcactgattggacaactttggataagtggtggagtacctactcaggtaaagaatgggattgggatagaggcccaacttaggggagttagagtctctcctaagacagagtgggttaaaggcccctcttaataaaaggcaaggacacttgaatgaccttgggttagaggcccaatttaggaggattagagtccctttctaagatttagggggttagtggcccctcttagaaaggtcactctgggtaaagtccctttgagctaagaacggtatgttaactgctattctctttggattaatctgccttgaactccttgctgacagctgtgggtaacaggattaggcaggtacaggaccattggacatggggaactatttctccctaaaacggaaaacttgagagctgatgggactgctggaaaagatccttcacaactatcaagcggccacctgaactgttcagtgtcactgcaatgggtgggtctttctctgatctctctgagtgcctccccttccccaccctgcctcaggcaatgctttcctctttctgtctctccctgtctctctttctctgtgcaaactggttgaattaatggtaaaaaatcactgtttatctcctataaagttttgattaatggaagaaaggatttttgatgctagacttaagctgcagcaaatctgatgtgctttgtgtgtttttctgtattattctgtcataaagaggggtaccttatgatagaacactggcttaggacgcttttcaaggcagaacagcaaactggtctgttacaaactttgctgcagtttcctgagaaaaactggatgagtttttttcttgtcttgcatgtccttgggaacttgaagctgtaagcatgtggccatgttttctcttttcacaatggcatcctgtgttcagggttcaatttctgcctcgggatgaattttttttatcttcttctgtgtatgtatttacatgtattatgtgtgtgtgatgtttatttctaaaacagcattgattaatgggtttaatgagagcttaaatcaaatattttgtcagaaaagtaaaaagtataatgccttttagttcatgtgacttaagtaattttccagaaataaagacagttttaaagattatcagtaaaataaaaatatcttcaaaaatgtaaacatttggcttaaattaggcaggtcagatattaagattgctaaatgcttgaaggtcataaactgcttctttaacttttgaaagctgttcaatttacctaccttgaagccattagattctagataagacctggggacctgcggagttagccacgccccctagctatgctggagtcagcctttatctgcacttctgcctggtgtatcccaggctaggcttcacacctagtacataattaaaatcccaaatttagcaacttttggtgaaaaaccttggtaagagtcaacattataacatgtaattgatactactgaagaaacagttttatatgcaattatgtaaagaaagtgaaatggccaggtgcggtggctcacgcctgtaatcccagcactttgggagtccgaggcaggtggatcataaggtcaggagattgagaccatcctggctaacatggtaaaaccctgtctccactaaaaaaatacaaaaaaaaaattagccgggcatggtggcaggtgcctgtagtcccagctacttgggaggctgaggcaggagaatggcgtgaacccaggaggcggagcttgcagtgagccgagatcacgccactgcactgcagcctaggcgaaagagcgagactctgtctcaaaaaaaaaaaaaaaaaaagaaaaatatttttaattaaaaaaatataaagtcatgggaatttagatttttgcctagattaaagcattaaaggatggtttcaagttaggatgaagctgactgttcaagaaagctgtggaagggttgtgaaaaaataactgtaaaagagattctgtgtgcaaacattggctaaaattaaaggggtattattcagtttttctggaaactgaacattggaataaaagcactactctactctttaacaaaaacttgtaaagggttataaaaggtttataaaaaccttaccttatggtcaatatgattaggattgaagacatttgtctataaagttttactaagaattgggtttgacatcaataatgcacaaatgcaacagtgacatttggcttatttaatattacaataatacaagaagcattatcaaatacaaaatggcatttgggtttctttgggctgtatttgtataaatgtgttactggtacatgttccaaaattatttttaaaaattctttaatcctgatatgacttagtgtatgttattaataattgttcattaaaatcattgtgtctcagaggcaaccacatttttctagtcaattttggctttaattgtggctgtcctaagacttttggtcatccaaaagtggtcttgttttggttctctttaaaaggtggtttagaattaactgtaggactctactggtgcttttaaatgcagatttctgataagtttggacattgtgacatcagaacagagggaaacctttcaggactcagggagagctaaaatgttcataaatatcaagcagaacagaagttaactgcatggactaaactagcaaaagtctaaagtaacctttttaactttttgtgtaaaatgttgctgatcttttgtgtttcagagtcaagaaaacttttgagctattatagcttttagcaattgagtaaagtatacttgtgtgaacaaaattgagagcatatttttttctttttacctgatttctctggattttgtaaactagttgtgagtattcttaatttatggcaatatagttatttgcatgagtgtaataagaatctgttgggttttgttttgttttctttattattattattatttttggcaacaagacacaattggagaaactgattattttacgaagactttgatggaatggtatactctcctttaaggaatcaaacttgacttgccaagtcaataaaagccccttggagaaatggcctcagacctttgctacaacagtccctgtacgtgatttctgacctgtggtaagtaaataatgtcaccttctaacaggtccaggagccccaagttatcttgggaccccaagaggagaggaatttactaaactcataggtatttgagggtacaaacccatggtagggctcagctcaaaaagagtcttatctaagattccttctaagaaacaaagtttcatcaaagccagtgttaaaagtctatgtgaaaaataattattcttgctgtactttatacaaataatcaggccaagtataataaagcaaattagtctcactatgacttatctttagtgaaaatggaaaacaggagagagaatattatgtttcaagacctatgttacacttgttattaaattctagtctcatcagttgttaagtttgtttctgcagtttaggctaaccctgcttcttcctgtgaaccaaccggtgatctttgtttgctactctgaaaaaacaagacattttggtaatgtaaaaatctggatcagtattctaattctgggcatgtattggaattggctaaccacctcatgtcagcttggttccagtagttgcccagttcatgaagagccttataatttagtttatttgggataattttgcttattttgttatattgctgttttactctttgtgtaggaatgcagactaagcttgctaaatgttttcttaaactaaatacttattagtctttcagatatcacctttcatcaggactcaagagttctgaatggccttcatcatactgaggctttctgactgagctcctctctaccctgaacacagagaccctaatagttaggcaggaatatcatttcccctattcagcctgaagaagttacagaagatgaatctttgtccccctacaaccttaggattaagggttctcttataaaagggagggaggaaatgtctaagacatgtgaactagagcaacttcatcctgaagaggagctgagtaaaataaggctgaaacctactgggctgcattcttagacagttaaggcattctaagtcacaggatgagataggaggttagcacaagatacaggtccttaaaaccttgctgataaaacagtttgcagtaaagaaaccagccaaaacccaccaaaaccaatatggccacgagagtgacctctggtcatcctcactgctacactcccaccagcgccataatagttcacaaataccatagcaacatcaggatgtaaccctgcataaataatgcaccccttgtttagcatatgatcaagaaataaccataataataggcaaccagcagccctcagggatgctctgtctttggagtagccattctcttattcctctactttcttaataaacttgctttcactttactcagactcctcataaattctttcttgcacaagatccaagaaccctctcttggagtctgattgggacctttttcttgtgacagattctgccagtttctgttcttggcaggttccatttctacaaattcctcatctctataggtttaggatcagaatgttccagcaggggagcattacagctgtttcaatcctcagggagactactcatcttgggaataattccttcctggagtgattggaaaataattcctaaaagaaattgaaaagtcaaattgttgaacggtaaattcaccatcacgtttaccataaagcatgtagagaaatggaaatagttacacatcatggttgagagtgcaggatttgcagtcagacagtttctggcacttagtagctttagaaagtgacttaagccctctaagccctcagttttcacatctataaaatgaagtaaataatataagcctctcagaagtggagtgagcgttgaatgaaatagtatgtgagtagtttaacgcagagactggcactgacataagaaactattgtgatagaagcagagcagagaaaatattttgaatagctgtatgcatggcaattttttaacctctttattcgtggcaactcatttaattgccacaacaaactaagtacttttattatttccattgttatggactgagctatgctaccctcttcatttcatatgttgatgtcctaagtcccagtgccccataatgtgactatatttggagacacggtctttacatggataattaagttaaaattaggtcattagggtgggccctaattcaatatggctggtgtccttatcaggttaggacacagacatgcatagagggaaaaccagaaaaaaggtataggagaaaaaatggttatctacaagccaaagagagaggcctcagaggaagccaactcaacaaattttaaaatatgtattttggagaacaaaattattagaaaatatttacaacagaaaaaaaaaatttcttctagaactgagctggtctaaaggtgcatatcttggtaaggctctgtgaagaaatgacctaatctggagagaagctgttgggacactcgtctgtgtgtggcctgtggctcacaggggtgggtattctcagaaagcacatgggaaaatcaccgtcctggtgtgtccaggctctgggaacaggctcttcctcgtggctttcacatgggtttcctggtgggctatgtagtcactttctgcatccttcttttaagggctcatgaacgtcacagaccctgagataccggtctcactgtcctcaactatcaaatgaggaggttgcaccaaagaacccctaaagcccctcccacctctaatcgcctatgggactgtccattcttcttaaggatcattatagacacacagcagggaacataaagtagacaaattctgagaaacagctaagaaaagtactacagacccaccagaatgggagtataaattgggcttcatctgccccattgcaacctagacttcctttgccttatgatttggctcaatggcatctgtgacaaggtagcttgaagttgacaccagtgcatccctggagattggatgggctgggctcagaatcccatacatcctttacagccttttttttcctcaccctatccataccctcaccctactagaattatgcatgcacttgttgaaaacagccctagcaaagtaaatctaggctccttaggccatgattaagggcccttgaagaagtcaaattacctaagaaactctagacatgcactctccaatatgcaagccactagttcgtgtctactgagctcctgaattgtggctagtgctaatggagatgtgctgtaagcatgaaatgcacaccagatgtacaagacttagtatgaaaaaatatattaaaatctcattaatagtaagattatttttatattgaaatgataattgttaatattgggttaaataaaatatagcattaaaattcatttctcctgtttttacctttttaatgagtctactagaaattttaaatttatgaatatggcatagtttatctccattggacagcactgctatttagagtatcaaaatttggtatcttttgtgacaataataaatcatttatcaaggagaaataccctagaattggacactcatcacccattatgtaacttcagctagcctcttggtttgtcctcctctctctcatagaattaataaagcaatctatcaggacaaaatgaatattgtcttgtttttctttttcattttttcaaatcattggaggtctttggggggaaaggtgatagcaagacactaggtgtgttatgaaagcatgagcctatgggcaagtttggatttgcttgttatccacgacaggaaattttggccaggagtcagttattcgcctagaaaatgaattgttaatgtacctgtgtactcttacagctatcacaactgcactttgctgaaattacatacatacacacacacacacacacacacacacacacacatttgattgttacatatcaatgttaggcagttttcctcctgggtgttttttccttatcattattatcatcattagtattacttctccttcacttctgtctcttgcaaaccagatatttgtttccctcacacagcacctgctttagaaataaaataaattacagaaaaggaattagtaaactagatttgctccttgaagtgtataaaagttgagtgtatagaggatgggaaggtgagggagtttgcaatggtttggatgtggtttgtcaccaccaaaattcatgttgacatttaaatgccagtgtggcagtgttgggggtggggtctagtgggaggtgttggatcatggggacagatctctcatggacagattaatgcctcctctcgggagtgagtttcactcttacagacttggttagttaccatgacaacaagtttttccttctcatgtttcatctctttggacattcccactcccccatccattttctgccatgagttgaagcagcacaagaccctcacaagatgggctgctcagtttgggacttcctgacctccagaattgtgagccaaataaaatattttttctttattaattacacagtctcatgtcttctgatatagcaacataaaacagactaagacagggttctctagggtatgagagtatgaataaaaatttctaattttctggtaatgaagtattttgggcaagaataacatgtatccagaaagaactcttgcaatgagaagtgtttgctgtctttccttttgttcagggacactgtctttggggacatatttaattcccaatagaaggaaatggcaataatgtatagttagataacaccatcttcgcttcttcatgcccccttaagatgttgttcactcttccattgcaaacatccagaacaaggcaagcatggacttcctagatctgggaggagagagaaaggtactggttgctacctaataccattgaatatctcagagctgggagaaattccactgagtctatgtctggagacagaagtgactgctccctggtgggaagccaatcttagctcagtttgtcaccatatttctgggggactactgcaagagcccccatctggtctctctaccttcagattagcccaatctgaaccaccctttacactgcactcagagggatcttctaaaatgtgaatctgatgacattctgcttgaaacccttcaaataaccttctatactctttaggataagatctgagacccttaacatgccaaacaatgccttccatgtgtgatttttttttgttatttctctagcatcacttttcaccctagacttgctgtccccgatgagacacctatatctcttatttcggcactttaactgacattacttcccgcaatttgttgagttcaatcctacagacatttattgaacatttattatgtgtcaggcattgttatgagactaccaagatgaagaagacaaagtccatgacgtcaagaaacttataacatctggaatgttctttcctaccccattttctggatgaacaaactggccatctctgaagtcgcagcctaagtgttgcagcagccttaaaggcctttccggccttgccaagacagaactgtaccctgtgcctatttctataacatctagaacagtgctgcacaaagccagtatgagataaaggagcccgtaccagaatttaaaccaatgcactgctttttttaataaagaaagacttggttcaaaaaataatatcagctacactaaacaatgtgcttaatggtacttgcttgtaacaaatactttcagaccaacagctggcctctggacagctgaaggagagaataaagagaatggtaagatgtagaattttcaatatatagttgctgagaattgagaaatttaataatacaaaagaaatttatggctagtaagccaacaaagaaaataaaatgggggcataaaaaaaatacatataggccagaaaagaaaagaagaaggaaacaaagaacagatggataaacagaaaacagatagcaatgtgacagacttaaacccaaacagatcaataaatacattaagagtaagttacctaaacaatccaattagaagacagatactgtcagattgtatgaaaagggaagactcaactatatgctgcccacaggacaccttttttatttttttaaattttagattcaagtggtgcgtgtccaggtttgttacacgagtgtattgcatgatgctgaggtttgggttttcaattgaacccatcacccaaatagcgaactcagagcccaacagattattttttaaacctggctccccttcctccctcccccaatttggactctacactgtccattgttcccacctttatgttcatgtgtacccagtggggaaacctactttaaacataaagacataaataagtcaaattaaataataacaaaagatataccataccaacattgatcaaaataaggctgaagtaactatattactatcagacaaaatagattttccaaagcaaaaaatatatattatataatacatatttatataatatattatattatattttatataatatatataatatataatatatttatataatatattatgtatttatattatatatttatataatatatatattatatatttatattatatatttatataatatataatatatttatataatatatttatataatatatattatgttatataatatatattataatatatattatatattataatatatattatataatatatattatatattatataatatatattatataatattatataaaatatattacattatataaaatatgtaaaataatgtatattttacatatataacatatattttatatatattatatattatattatatatattttatatatattatatatttaatatatttttatatataatgtgtatattatatataatacatataatacatataaaatatatacattatatataatacatataatacatataaaatatatattatataaaattatacatataatacatataaaatatatattatatattatatacaatatcacaaatatataacatattgtatataatatataatatcaaatatataacatattgtatataatatataatatattgtatataatatattgtatcttatatattttatattttatatgtatttatatatacaatacatatctattatatgtatattatatataatatgtattatatattttatattcattttatatattatatataatatatgttatatattttatatattatatatttattattttaataataaatatatatattttatatgtattttatatatatatatatatatatatatatatatatatatatatatataaccagggataataagggtcacttcacagtgttaaaggggttaattcataaacacaaaatccaaaatgtttattcccctaataacagagtctcaacatacatgaagaaaataagtgattgaattgcaagagaaataaacaaatctaccattatacttgaatatttcaatactcctctttcaataattgatataacaaataattgatataataattgatagaaagtcgtaagagtacattcaatttgagcaatgttatcaactaatttgatctaaatcgcatttacagaatacagcttccaacaacagcaaaacacacctcaacaacagcaaaacacacctctctatgcatctctatgcatcacctctctgttccattatgcagttaattatgcaattaagcaatcttgtcaggaccataatgcaactgcattatgcaattgcatatgcataatttgcggaccaaattatgtttaattgcataattgcaattgcataatggaaccatagcactgtcactgtctgacagtgctatgcaatgtgagacattgcaaagcacacctcaagattgcttgaggacaggagtttgagaccagcctgggcaacatagtgagacccctatctctaaataataaataataaatgaataaataaataaataaaattagctgggcatggtggcgggcacctgtggtcccagctactcaggggctaaggcagaaggattgcttgagtctgggaggttgatgctgcagtgagctctgatcaccccactgtcctccagcctacatgacagagtgagaccgtgtctcaaacaatacaaaccaaaacaaaacaacctaaaatattatccacaattccttatttgaaaccatagaaggtagatgctttagaatccagaagatttttcatattagaatagcacagactgaatattatataacctccaggaattctggggcagagcgcatctgcagtgaaatagaagtgtgtccacaaggcatgggataaatgcagactatagaaagactcataattatacactgtacaaaggctcatgccggttcagaccaagtttttgttgctaaacgactttttattaacttcatggaaaatgtccattgtgaaagttttttggatttctgaattatagataaggaatataggcctgtacagatacatatacatacatataattggatgaaagttggaaaatacagaaaaccaccaagaaaaatattcataatcctaccattcagaagtaaccacaaacattttggtatatgtaccattttgtttgcatcttttacatatatcaaagaccttttatatatttatatatgtaaaatatgcaaacacatatttttttttgcttattccccctccagagaaacaggattaaattcacattttctcttaaatatataaaatgaacatttatctatgtcagtaaatattctactatagcctaatgtctgttttgagttttattgtattgctattccttaatttatcaaacatttaggttgattacaatttttcatgttataaataacaatgtaatgagcatagttatccatacaacttttggtgtgtcctgattttttcctaggataaattactagatgtagaattactgggtcgaagggttttcttttatcaaaaagtttacaaaagaaactttaaaaatatgttttcatcaaaaagtttacaaaaaaattggtaagtgattttcatgcatgaaaatgagtgcttattattgatttcactcattgtcattgttttagagaattgccttatatttagaataaacatctgtattcagaacacggtcgcatctttttttttttttttttttttgagacagagtctcactctgtcgcccaggctagagtgcagtggtgcgatctcagttcactgcaacctgtgcctcctgggttcaagtgattcttctgcctcagcctcccaagtagctgggactacaggtgcatgccaccatggcaggctaatttttgtatttttagtgagggtggagattgggaggagggtgagaattgaaaagctaactgtcgggtactatgtttattacatgggcaatgaaataatccatacaccaaacccccatgacaaataatttactcatataataaacctgaacaggtacccccctgaacctaaaataaaagttgggggtaaaaagaagctggagagaagagagcctcccttcctgaggataatagccttcgtgtatgccagacactgttataagcattttacacattatggctcatttagtgctgaacctgtatataggatgtaggttgacaaaactgaggcacggaaagcataagtaacttgctaagggtaagaaagattgtaagaatagaagcaaacactactgaagggaagacaacagcactcagacacattgagatgagaaccaagtaacattgatttacagaatatacaggcaaatgggatgcgctgatagagctccttttattaaaaattctgcaggaataaaagaaaattcatggcaactatgcagagagcttaacacaaaaaagaagaggaaatatagtataaatgggaaagtgaaaaatccatcctgaaatctaatataagcctaagaaacagagaaaaaaatctaagacaagtattttgtatctagaaaaaaacaaagaaaacatattcattgaaacaaaaataaataaatacttagatgagacaataaaataagatggaaaaatggtagttacaaagctaaggaaaaattgcagatcaaaacagcaattacagagttaagtaaatttgaaagagcaagaaacaaaattaacatagtcaaatattaaattcatcactttcaaaaaagcttgagataatcatagaaggtgtgtagggaaaagacaataaagtcgaaatggttaggatgaagattaagctatgagggatagataatgatctacccatgggtccttgtttccccaaaagaaagactacagtgcatgaaatacaaaaaatatctaccaatataaaagaaaagaaagagctggctaggaaattgaaagggctccctggattctggaaagaagtgacagtgctggctcaactctgagacatacttgatgaatttactacacttcaaagtaaaagaaaatagtctcatgtattcaagaacaaaaagcaatccacttacaatggtggggtagggctgggagaggaccctgagaatcaggcagcatttgatgcaagaaaatagtaaaacagtgtccacaaagttcggaggaaaagaaagtggaacacaacaatttcctaccatacaagttcttgttaaatcagatgcagtagtcaaacatataaacactagagaacataaaacccgtgagcccttcttgtaaacgaaaataaaacaaactgacccaagagatgaatcgaagtagatttcagaaattgattggtgttggcatcagaattcttctcatagagggaattttccttagaaaaaagaagctttcataagcttctgggggtagtacagaattccataccttcagacttttccatatctgtatattattccttctgttatttagttaatacgtttctttaaactcactttttaatttagattcatatgtttatgaaggaatcttgcaatcataagccgaaaagaaaaattggcatcacttacggtaaatagaaggtagccaagcataaaaataaattcgatgaaacaaaaacaacgttattaatataaccagatatcattgccagctttaagagggccaaagctgaagcttgctttctctttcataaaaagagagtttggtaggtgttagatgttatgtgcttattctcaccaaacagactgtctttgactaattcatcttactactaaatagagtgtattagtgcgattcaatgaaatttaatgctgtgttcttgcatcaccttaaatctcactttgggtgctatgagtggaatttttgtgtgtcttttccctcctgcaaattcatctgttaaaaccataactgctaatgtgatggtgttaggatgtaggatgtttgggaggtgattagggagcaagagcggagccctcacgagtgggagtcatgccctcatgaagagattttggaggctagctgagagagacagagctggacatactggctcgatggagctctgggtgttgctcccacaacagcaacagcacagagcgctgaacacacaccccacagttcaccatccatggccaggagaccattcaaaacgtgattgctggttgtcaactccaagaactaacaggagtgaaaactcacacacacacccaagaatgcagactctgcctggcacacagggaagtctgccctcgtgcctggggttccttcctctgtgggcttcctatcttcagagccttggctctcccttcccctgagggattactcaccacttccctaacactgctgggctgccctgctttgctgccatggagtccagtcatcaggcagattcattcacatctaggcgcctgagtggtactggccaccacgtaatggagtggacatcaaaccgagaagtgggcaacctggaattgggtgccagtcctagagtccctcatcagccaaaagaaaattatctcgcgagtgcctaccttccagaagtgtcacggggagaccatcaggtgtgtaccagaagcacttcctacattgcaaagcagcaaagaaaggcagcctctatagtggtctgtaaagagtgccttgcagagaggacacagcctggctgatgagtttccagcagtagagcgttaggtgtgattgaatcttggagaggaagagacttggttctgttgaacctgctccatgttactcaaagcacacaccacacactctgccaacaggtaaagcttcggatgctacctgctgtgttctgtcctctcccagctgagccaggccctgggagccccctccaggagctccgggcaagcagcccctcatggtccatggtggaactgcaccctcagcactggtgagggtgtcgcaggagcctgcgaggaaggtggggtctcagtgcttttgcacagggcgagtggagctggaaatgcagcccccagtggtttcagttattccaggtatgacttttctctctcatcttgcaccttcggactctaatttcctgtgagcaatgtgctgggaaaactggcagcggctctctggcaaccgtgggggaaagaagcaaagtggggcagaagcggaagccaggggcaggggctgggtcggtccagccagcccgctagggctcccatgtagcagagattccactgagaggaagccggggctggcccggccgggagactccctccatgccccgtgtgtggagtgtcggggcaccctatatcctcaaggtggccttgacctctggagacaggtgttggctccttgagtcaccaacagcagggaccagactgggaggtgtttttgggcgggaagggctgggccaggccaggctccagcaggcccccttgtggtcagagggactgcctgcaggatgatgggcttggggaccaaggcagccactccccacatgggagttggacccaggcttgaaggacacaccgtcacatcgatgtcactctcttgggaggcctccttgtgacacaagatgtcctggccccggtgtttttcttcaccatattcctcccaactgtaattgtgtagttcctggggtgcttatctctcaatgtccatctctgtgaaaaaagccgtgaccctccgggataaggtctgttcgtgagactcactttgtggaaaggacatatgaaagtctcaggactctacctaagagctaggatccagctcaggtcccagctccactgcaccaatgcccctcggtccgaggagagactgagatctctgtaaacagcagagatcagtaatacaggctttgccctgctgaaacttccctctgaaaggaagcataatgctttcagccaagtgcctgcccagagctctaaatagataacagtttagaaggggggtgtgatcaccaagggtacagatgggcttcacagagcccataacccccaccaaaattgaatgccaatgtgtataggtgtgtgcctaggtgcattttcctcaggaaaggtccaaagctttcataggattctcaaatggatctagatcacatagagagaggagagggggttgtcagcaggagcagcccaggagacactcagtgagaatacgcaagggtctgcacctgtcagactttggtctgcataattatatgcataatttgcatataatttggtatgcaagattgcaatgcgattaagctatcttgcagtatcttaaagaaactctggtaaagggtaccctagatactagtaaaatgaattagctgtgcacatatgtggaggagattgtaactggggtggaagtaagacttcactgtatacctttctgtgtgaattgatttttgagccaatgtaatgcctattctaaaacaaaatatagcacttcatataaagggcaaaattaaaacataatggaaaaactaccaaaacccaatgaggaagtcattgttccaatgcccaagttggggtggagtgaagcagagaacattctccaccactttgcaggtgtggaggaatatggctggacggaattcgcagaagagcacagctcccgtggactctgtccttccagagcctctcaacccttgtcagcctgggaagggggcctgaaccagtgaaccagagcctctcaaatgtcagcctgagtaattttttgcctctaagtattcttttgtggcttcttctgagaaggttcacaaattttccttttctttacagacatctcacaaatccttaaggaggaggctgtgtccctagagtcctgtagtcgagacatttgagaatttgggacccagttggaagtggttgcgtatttccattgtgtgggaatatgtaaaaggcccaagcctcaccaagaagggaagaccaggctgctctcatctcaagggccagttgcttcacacaccggagtgggcctaatgttcaaggagcttctttctccatttctccccacagtgcttaacgtctcaggccacgggctgccagcactcacctgccgaggccgccctgcggcctccctgttctgaggcccctgcctctccctgatgaaacttcctccgtgctaacttggcaagaaaaggcaaacgctgctgtgcttccctttgcccttgaaaagaatgaggtttaggggaggctctgcacagtcctgtgctgtccgggatagctgagcagaagctgttgaagccggcctgctggactgagcttggtccagcagcctatccacgtgagagccctggctatctggaggcacagggagctgctgggcctgcagcgtcccacctggagggaaagaacgcaccgccaaggaggcgtgggccctgcagcccgtgctgggccgcgaatctggtagccacgcttctccggcggaacgcggcgccccctggcggcagaacgcttgtggccgccgttacactcgtgtggaaacagcgccatctgccgaatgctccatctcattgctgattggcccacacagactttgtaaggatttttccttctgcttgcttaaatcaggccatattgagcctattcaaagtgtacttctgaaatgaaaaaagaaagtgactgtacaagatgttttgctcactggaaaaacgaggatgaatggaaaatgggtagcgattatctgaataatatgtgcttcctgtctgtagtgaggtgtgaacatggtggggccgcacattgcagaggaaaacgcatgcattttggagtcaggcaactgcgatcaaattcttactagctttgtgagctaggaaagttacttagcatttccaagcctcatttgtccttatctgtaaagtagaagtacatttaccttgcagcattgtagcaaaagttaaataaaacaatgtgcataaaatgaaaattaaatgtgtatgaagtaagataatatatataataggtagactttaaagtataacataaaaatatcacatagccatttttttctaattgttagaattgtgaaatattcctgaaatggatttatcaaatgagaagacagaatctctctgaggtatttttaaattttctctagaatggttgattctgacctttctgtaaaagacgatctatttctgggcacagatcctagaaacagaattctgccaaagtgagactccactaacatttattgaatgtctgccgcatgctacacactttcaaagatgctctttcattatcgccagtaaaatctgaagcttcaggatctattcctcttcccagcagaaagttttgccaggaatatcagaacctcttttttacagcctctcaagtactttcaagattattcagaaaagcccaaaactttgaacaacccaaatgccaattaacaggagaatcaacgatactacatccatacaatgaaatattactgggcaatgaaaaagacaaacaaccagataaacatcataggagggactctcaaatctgaggcaaaaatagtcaggccaaaaaatatactgtatttgcatgaagttctagaatatgaaaatctaattgatggtggtagaaatcagaatcgttgtccgcacaggataggcgtggggattgactgcagaggggcactagggaacttgtggggtgatggacatgtcctgaatgttgatctgggtgctgattgcacagttatgtacaggcagtggtgtgctgaagcccgctggcaccatcaagagagtggactgttaatttttcaggatgtctgcaagccagtcaacatcacattgatagcttggaatccaccacggtggaaatatttatactccagaaattggcaaacactacaaagcagggcttttttatcccaccagagagccagttgtaaaacatgtatgaacacaccactgtatacatttgccaaagctcattgaattatatatttcagatctatgcattatattgtatggaaattatatttcaaaaatgggggtgaataaaagctctctgctatcagagtgtgcagagcacagctggaggcccatgctgagcagctggggagaaaggttggaatcagtcatttctgggatggaaaagcaaaatttaagaagtctttctcagtcataatggatctaaagcaagaaagcagatcaaaatacataagcctcagaattgaggcacaatactgggtcagcattttgataatggctgcatagattacagatcatcagcctcaccttagcaaggaggaactggaggcccatatcagaatccaatgttcatcttctataattttattaattttattctttaaatcatcagacaggccaggcacagtggctcacacactttggaggctgagacaggtggatcacttgagcccggaagtttgagaccagcttaggcaacatggtgaaaccctatctctacaaaatacaaaaaattagccaggcgtggtggcacatgactgtagtcccagttattcaggaggcagaggtgggagaatcacctgagcccaggagctcgaggctgcagggagccatgatcgtgccactgcactccagcttggataacagaatgagaccctatcaaaaaaaaaatatatatatatatatatatatatacacacacaaaaatttatttttttggtgtacagttctataattttaacatatgtatagattcacataagcactgccacaatcaggattcaaaatagtgccatcacacccccaaaaactccctcatgttttccctttataatcacagcctctcccactcgtaactcctgacaaccacaggtctatccttcatcagtattttatcttctcaaaaatgagaaatacagtacgtaaacttctgagactacttccttcccccaccctccagcatcatgccttggaaagtgctcagttgctgcatgtgtaaatagttcattcctttctactgctgagtagtatttcattgtatggatataccacaacttctttatgcatttacctgttcattcacctgttgaaggacatttgcttggagcaattatgaataaaacatcaaataatcatagaattatcaatagaacatttatacacaggtttttatgtgagcattaagttttcatttctctaggaagtggggtttctgggttataagacaaatacatgttaactttgtaagaaactgccaaacttttccagactggctataccattttttattcccactcacaatgtataagaatggaaatagagctttgggaagccgaggcaggcagatcacaagatcaggagattgagaccatcctggctaacatgatgaaaccccgtctctactaaaaacacgaaaaattagccaggcacagtggcgggtgtctatagtcccaactactcaggaggctgaggcaggagaatggcatgaacctaggaggtggagcttgcagtgagccgagatcacaccactgcactccagcctgggggacagagcaagactcagtctcaaaaagaaaaaaaaaaaaaaagaattgcaatagagagaagaatcaaatagatgcaataaaaaatgatataggggatatcaccactgatcccacagaaacacaaactaccatcagagaatactataaacatttctatgcaaataaactcagaaatctagaagaaatggataaattcctggacacatacaccctcccaagtctaaaccaggaagaagtcaaatccctgaataaaccaataacaagttctgaaattgaggcagtaattaatagtctaccaaccaaaaaaaggccaggaccacacagattcacagctaaattctaccagaggtacaaagaggagctggtaccattctttctgaaactcttccaaacaacagaaaaagagagaatcctccctaactcattgtatgaggccagcatcatcccaatgccaaaacctggcagagacacaacaaaaaaagaaaatttcaggccaacatccctgatgaacatccatgagaaaatcctcagtaaaatactggcaaactgaaaccagcagcatcaaaaaccttatcaccatgatcaagtcagcttcatccctgggatgcaaggctggttcaacatatgcaaatcaataaaggtaatccatcacataaacagaaccaatgacaaaaccacatgattatctcaatagatgcagaaaaggccttcgacaaaattcaacacccttcatgctaaaaactctcaataaactaggttatcgatggaacgtatctcaaaataataagagctatttatgacaaacccacagccaatattatactgaatgggcaaaaactggaagcattcccttgaaaaccagcacaagacacggatgccctctctcaccactcctattcaacatagtgttggaagttctggccagggaaatcatgcaggagaaagaaataaagggtattcaaataagaagagaggaaataaaatcatctgtatttgcagatgacatgattttgattttatatttagaaaaccccttcatctcagcccaaaatctccttaaactgataagcaacttcagcaaagtatcaggatacaaaatcaatgtgcaaaaatcacaagcattcctatacaccaataacagacaaacagagagccaaatcatgagtgaactcccattcacaattactacaaataaaataaaatacctaggaatacaacttacaagggatgtgaaggacctcttcaaggagaactacaaaccactgttcaaggaaataagagaggacacaagcaaatggaaaaacattccatgctcatgggtaggaagaatcagtattgtcaaagtggccatactgcccaaagtaatttatagattcaatctatctccatcaagctaccactgactttcttcacagaattggaaaaaactactttaaacttcatatggaaccaaaagacagcctgtatagccaagacaatcctgggcaagaagaacaaagctgaaggcatcatgctacttgacttcaaactataatgcaaggctacagtaaccaaaacagcatggtactggtaccaaaacagatatacagaccaatggaacagaactaaggcctcagaaataacaccacacatctgcaaccatctgatctttgacaaacctgacacaaacaagcaatggggaaaagattccttatttaataaatgatgttgggaaaactgggtagccatatgcagaaaactgaaacaggaccccttccttatacaaaaaataactcaagatggatcaaagacttaaacataagacctacaaccataaaaatcctagaagaaaacctgggcaataccattcaggacataggcatgggcaaagacttcatgattaaaactaaaacaccaaaagcaatggcaacaaaagccaaaattgacaaatgggatctaattaaactaaagagcttctgcacagcaagagaaactaccatcagagtgaacaggcaacctatagaacgggagaaaatttttgtaatctatccatctgacaaaggagtaatatccagaatctacaaagaacttaaacaaatttacaagaaaaaaaaacctcatcaaaaagtggccaaaggatatgaacagacacttctcaaaagaagacatatatgcagccaacagacatatgaaaaaatgctcatcatcactggtcattagagagatgcaaatcaaaaccacaatgagataccatctcacgccagttagaatggtaatcattaaaaagtcaggaaacaacaaatgctggagaagatgtggagaaataggaacacttttacactgttggtgggactgtaaattagttcaaccattgtggaaggcagtgtggcgattcctcaagaatctagaactagaattaccatttgacccagcaatcccacttctgggtatatacccaaaggattaaacatcattctactataaagacacatgtacacgtatgtttattgtggcactattcacaagagcaaagagttggaaccaactcaaatgtccatcaataatagactgaataaagaaaatgtggcacatatacaccatggaatactatgcagccataaaaaaggataagttcatgtcctttgcagggacatggatgaagctggaaaccatcattctcagcaaactatcacaaggacagaaaaccaaacaccgcatgttctcactcataagtgggagttgaacaatgagaacacatggacataggaaggggtacatcacacaccagagcctgtcggggggtagggggctaggggagggataacattaggataaatacctaatgtaggtgatgggttgatgggtgcagtaaaccaccatggcacatgtatccctatgtaacaaaactgcacgttctgcacttgtaccccagaacttaaagtataataataataaaaaaaaaatgtaattgctctcaacagttcttggtattaccaaaggttttccttttttcagcaattctaataggtgtatttggtttgtttacaagtctctaatgcttaatgatattgaacatctttttgtgttttatttgccatttatatattctgcaaagtcttgtgacatatgtgacttgcaaagtttttctcctgggctatactgttttcattcttttaatagcatcttaagtcttttaatttcaataaagacctatttatcaactttttcggatcgtgcttatagtaccgtgtctaagaactcttttcctaatcccaggaagagattttctactatgttcttttctgaactttttagagcttcacttttacatctcatcaatattgagttcatttgtatacaagctgtaaggtttcagttttcttgtttgtctgttttgtttatgtgaatgttcagttgttctaacatcatttgttgaaaatatgatcctttactgaattacccttgcacccttgtcaaaaatcacatggccatatttaagcagttatctttctggactcgattctgttccattgagctctgtgttcccaggcaataccatactgtcctgattactgtaactttgtagtatgttttaaaactgggtagcatgtttcctacaccattattcttatttttcaaagttgttttagctattcaagtccttggactttccatgtaaacattagaatcagcttgtctatagcaacaatatgtcctggtgagattttgactggaattgttttaaatctctatatcagttttggcagaattggcaactttttaaagttaagtcttccaatcttcaaatatggtgtttcttgttatttgtttatatcttctttgagtattttcactggtattttgtagctttcagtaagatgtttatctatttcattttttggtattctatgtggtactggttttcaattttcctatccaattccacatttctggttgtgatggttaattttttttttttttttttgagacggagtctcactctgttacccaggctggagtgcagtggcacgatctcagctcactgcaagctccgcctcccgggttcacaccattctcctgcctcagcctcctgagtagctgggactacaggcgcccgccactactcccagctaatttttttgtatttttagtagagatggggtttccccatgtttgccaggatggtctcaatctcctgaccttgtgatccacccgcctcggcctcccaaagtgctgggattataggcgtgagccaccacgcccagccttgaggttaattttatgtgtcaacttggccatgccatggtagacagtttgggctcaaacaccagtctagatgatgctgtgaagaaatgttttagatgtgattaacacttaaatcaatcaactttgagtaaagcagatgaccccccataatgtaagtggacctcacccaatcagttgtaggccttgagaagagagactgaggttccttggaaaagagggagttctaccagcagacggcctccaggcatgagctgcaacatcagctcttccttgggtctccaccatgacagcctgctctgtagaattcaaatttgccagcccctacaatcacacaagcaaattcattaaaactaaccaatctctctctgcctcgctctttttaaacacacacacacacgtgtgtgtgtacctctcacatatatacgtgtgtgtgtgtgtatcctattggttctgttttcctagagaaccctaatatgctgatgtataaaaatacaattgatttgtttgtgtgtgtgtgttaaccttatatcctgcaaacttgttaaactcacttattagtcctaagaggtctttgcaaactcattgggtctttgacataaacaatcatgtacactatgaacaagaactgtcctctccagggtggggtgggcaccaggttaagagttaggcatctccttgagatgtccttatttgcttaggtcctgcatgaaagcacatagtgccctagctcttttgaaaagcaggaaaatcctgaaagaaagcaacacagagctttctccattgtgaggtagtgaggaggggattaggacactaggtgagaaaggacaggcctagacaatgaagcaaggggcgagtgggtggatgggtaaaaccacctgctcctcaaaacagccaggctctgagatgaagcaggaatctgcacttaaaccgaggctggatccatcctagggattcaagtgagtctggcattttgacaggaatcccagtggaagtctttttgtggagtgaagggcgggggtgagttgcaaaattttctggaccagaacttattgtaggaaaagaagaattgaagctgggtatgggctcctgcttatggtcccagctactcaggaggctgaagcagggggattgcttgagcccaggaggctgtggtgtgctatgatcacacctgtgaatagctgctacgctccagcgtgggtgagagagcaagaccccatgtctaagaaaagaaaggaaagaattcaggcactgtgaggtaacctaggaacaaagcttcaaaacattctgagtacaacagaaaaaaagaagttttacttaaagtccataaaatcctgggacattagcaaccttttttggaaacccctctcttaaactgtaactctagggagacagaggttcccatagaccaacagagcacatggccccagtgcccagcagagcaacgtggagctgcagagtcctgtgggggctaatttgtacacaagcacatgtaacacccccacaggagcccagacttttcttctgtcttgttgcagactttcaaagagctagagaccctgtcaaatcatgggggtgcaaaaacccatgcaattgaggggttttaactcatggtatgctgtttctgcaggcctgtgttgtcaagcgaaaacagaaaagagaagggaattccacctttgcccactgagaacacatctatgctgagaacacatctacccaactcctctgtcacaacccctgtgagaaggttctgccatctcccagccctgaagattgtgaggtcatctgaccacttattacattgctaaacatggcaggatgtcacctgactcgacactaagctgcccatcaatcatcacatcccctttctcccacttacttttctatcaccccgtagattcccaacagctgtccttaagtcctccaggctacagaaaccactcttgaaacaatatgtcagcataccattagtgccctttaactcataccctcacttcccagcccctcctctgtgaacgaagtctctccttacctcttcctccagcactaatcaatctaatgttccttcactcttttctcccctcccagcttccctccaacctgcacccaatccccccaaatcctttctcctctttctttgcaattctccacaccaagactgaacacttgtcagaaatggtgctccccctgggcccctccacacctcctgaagcccaatccctgtcacttcttaccacccccagctccctgatggccctgggcctccctcccgacagctgaggcccttcctggatctctacacgtcaccaagctaagccagtgttccaaaatagtctcctgaacaatgatgacaactgcacagttattttggaaggtaagtgtggccagagtcccagaacaatgcaggaaagacaatgggatggtgggcagcaggtagcctggccagctctgtttgtgcagatgaattcaggagcctggcatttccttgaaggatgaccagagaatggatgagctctcaggatcacactgagaccaggtccctaatgctcctaatcccttaggacacaaggacctgaaagacatagaaactgcttctctgaaaattggcttgattattctcccaaagttgaccaggatccagagcttagattgcaggaggtcagggcatatgctgaggcctagctgtcttcaagctgcagtttccaagatagcccagaatagagtccaatcaatatacggcaatatatttcttctttgttttctgtaagttttataaaaacacacatatagaaatgtacataagtttacagctcagtggattttcacaaagtgaacacaccctcaaaaccagcacccagataaagagaatacaacaaaaacagcagagggcctcctcacccctacttccagccaataccccatcccctaccccaggataaatgcaatcccagcttctaacattgtgcattggttttgcctgttctttgaactttctgtagcagttatagagtatgtacacttctgtgattggctcatttcagccaacataatgtctgtgagattcatccttcttggatatagttccagttaattcattatcattattatattgcattcaataaatattactacaattcattcatccattctattctccggtatttgggtagtttgcagtttgagggcataagtagtagaagtattgtgaatattctaagacatgttttcgttaaacatatatgcagctctgttgggtacagtataggccttggagtggaattacagttctcagaaacaaaagaaaataaattcaagtttgatatagacctgattgttgcaagacatagattccctgattgtagtgaacctgagttggccatgagcagtggaaggagtgtgcttgttaaaaggacaaatatgatgctgggagacatgtacaaatctcaagagattattcagggaagcaccagatttattttaaatgatgggaagaggtgtcaaataaaggttataaaaacattccagtaaataaggccaatggtgggttgataatatcttcaaagaacatgtttaggatcatacggttcttcttcattcttctctgcagaacttcctggcagtgatggcagtggaacattggaaacagagatgaacaggaggtgggaagaggaggctaagtacatgtaggcctaaaagtctctgccttgggagatttttaacagtcctggatggaggtaaggaggcaggcgtgattctaagatctcaaggaaaggagattctatgtcactcttctcttcccttggccctcagactgtttacgaacaaaataatttcatcaattatttcattatttcattatagcagatcccctcactgagacttccaaagatttttatcaacaattttatgtcactcccactaactctttgaaggtaaatggcagaattaattttcccgtttaaaaaacagaaacacaaagacccagtggagtctgcattttctagttttagtcagccattctggaagctgcgtcctggtaaccgcagtgtcccagctgtgaactccgggcaagtgtacagcatcatcttccattcaccatgtggttactgcacttctcatacaaactacctgcgttactcagttatccagtatcaaggactatgccacactccttagagcagatgcagggcacttagagattaataaaacaggccgagcacagcctgtaaccccagcactttgggagcctgagatggaagaactgcttgagcccaggagttcaagaccagcctcggcaacatagtgagacccccatctctactaaaaataaaaaattagccttgcatggtggcaccttcctgtggtcccagctacttgggaggctgagatgggaggatcccttgagctcaggtggttgaggctgcagtgagttgtgactgtgccactgcacaccagcctgggcaacagagcaagactctgtctcaaaaaaattaattaattaaataaaaataaaaataaaacccttttagagttcaagtcttaattgccatatggctttgagcaacttattttatctcactgtgcctccatttcctagacctggaaacgaaaataagagagaatgaaatttaaacagcttctcagaagagtatgtaagttaagccacataaaacatataaataaatatctgtcacttagtagccactcagcacatggtaattacaaagcatggtgccataagaagttgctggggaggcagacatgtaaatgaatgcagaaaatatatgaggaatactaaaatacaaattaaagtgtcctgtggctttttcatccacatagatgagtgtcaaagctactatctctctgggaggatcatggcagacaggaggcaggtctagattgcagctcccactcagatggacagagcagcatgtggagtattgcatcatgaacttttgctccagaatgactgcaggaagaaatcaggaaagccaagagaacccacagaccctctgagggaagtgaattgctcctgcaggacctgggagacaccccaaacaccatgagtgcccaaactatggaagtcggaaaggggcatcgttcacccccaaacacacaacctcactggggaaccgcaagatctagatcactggagaagattctgacattacctggagctgagtcaatttagagagccgagtgaaatgcaggggtagaggaagcagtgggaaaatccctgtgggctctctgggtgacctagcaatccatttctgccttgcctcccaggggtcattggggagggctaccagaggcactgggaaaaggccacagggagaaggaagcctccagctgaactttgtaacaattccaactgaacaagaagtctcctggccagaactacagggagggcgtgaatcctgtgtgcagaccacaggcagggaagcacgaagggttcacagctctcacagctgggcggctggtagcctggggcaagctctcagccctgcttgcccactgccctggacacagacttggtgctgttgagcagggaatggtgagagtgagactggccctttgggttgtgagggagctgggtgaggcctgtgattgccagctttccctcacttccctgacaacctgcatgacacatcagaggcagcataatcctcctaggaacataactccattgacctgggaaccacacctccatctcccacagcagccacagccacacctccatctcccacagcagccacagcaagacccactcaaggagagtctgaactcagacatgcctagcgctgcccccacttaatggtccttccctacccaccctgctagctgaagacaaacagcgtatactcttgggagttctagggccccacccaccacctgatccctcccatactaccatagctgatgctctctggaaagtgccacctcccagcaggaagccagccaactcaaaaacagtgcattaaaccaccaagactaaggaccctcacagagtccatttcacccccctgccacctccaccagagcaggcattggtatccacagctgagagacccacagatggttcatatcacaagactctgtacagacaactcccagtgccagcccagagcctggtagacctgttgggtgactaaattcagaagagagataatactcacgacagctcagatctcaggaagccacatccctaggaaaagggggagagtactacatcaagggaacaccctgtgggacaaaagaatctgaacaacagccttgagccctagaccttccctccgacagagcctacccaaatgagaaggaactaggaaaccaactccggtaatatgacaaaacaaggctctttaataccctccaaaaaatcacactagctcaccagcaatgaatccaaccaaaaaaaaatccctgatttacctgaaaaaaaattcttaaggtcagttattaagctaatcaaagaggtgccagaaaaaggaaaagcccaatttaaggaaataaaaaaaaaatacagaaagtaaggggagaaattttcaatgaaataggtagcatatagtaaaaagtaatcaaaacttcaggaaccaacggatgtagttatagaaattcaaaatgctctgggaagtctcagcaatagaagcgaatgagcaggagaaagaacctcagagttcaaacacaaggttttcaaaataatccaacaaaaacaaagaaaaaagaataagaaaatatgaacaaagcctccaagaagtctgggattatgttaaatgaccaaaccaaagaataatcggcattcctaagaagaagagaaatctaaaagtttggaaaacatattagggtatccactactgggtatctacccagaggaagtcattacatgaaaaggatacttgcacacatatgtttatagcagcacaattctcagttgtaaaaatgtggaaccaacccatatgcccatcaatcaatgagtggataaagaaactgcagtatacatatacgatggaatactactcagccataaacaggaatgaattaatggcattcacagcaacctggatgagatcggagaccattattctaagtgaaataactcaggaatggaaaagcaaacattgtatgttctcaatcatatgtgggagctaagctatgaggatacagagacataagaatgacacagtggactttggggactcagggagaaagggtgggaagggagtgatggataaaagactacaatttgggtgcagtgtatactgctcgggtgatgtgtgcaccaaaatctcacaaatcaccactaaagatcttactcatgtggctgggcgcagtggctcatgcctgtaatcccaacactttgggagaccgaggcaggtggatcacgaggtcaggagatcgagaccatcctggctaacatgatgaaacccatctctactagaaatacaaaaaattagctgggtgtggtggtgggcccctgtagtcccagctactcaggaggctgaggcaggagaatggcatgaacccgggacgcggagctggcagtgagccgagatcgcgccactgcactccagcctgggcgacagagcaagactccgtctcaaaaaagaaaaaaagaaagatcttactcatgtaacaaaacaccacctgctccccaataacctatggaaataaaataatttttttaaaaaaaagaatctaggctgggcatggtggctcacgtctgtaatcccagcactttgggaggccaaggcgggtggattacctgaggtcaggagtttgagaccagcctggccaacatgatgaaaccctgtctctactaaaaatacaaaaattagccaggcgtggtggcacacacctgtagtcccagctactcaggaggctgaggcaggagaatggcatgaacccgggaggcagaagttgcaatgagccgagatcgtgccactgcactccagcctggccgacagagtgagactgtgtcaaaaaaaaaaaaaaaaaaagaaagaaagaaaagaaaaagaaactaatagggaaaaacagctagtatcactcttacatgagatctttaggcattatacagtaagactgtctcaatctcagtaagaactaagtaaataaataaaataacagacttttgtgcatccaaaactttcaggcaaagattgtaagttctctagcatcattatatgcccaggttatatttctcaagccttacttgttccttccacacattaacatttcagaattatatttcatttataacaggtattctctaggctcactaacctgacagggttaatatcaaaaaataaaaacaaaaataatggcatttaaataaaaatagcctctggcttgagcccatcctagcaaccacagtgaaattccagcttcccccaaatcttctcagagttcttggatggcctgagaatgatccccacagcctctagacgctacctgcaatgttctttgcaaggagctcccctcttcccttcaattggttccacctctgtctacaaagctgctttcctttctctcttatggctcactttactgatactgaactccttgcttcccaatattgagatctgctgtgtcctggggctggggctgtacctctcccgtatcactcccctgctcttgtcaccatcagcgcttctgtcctgagctacaagccctcagctaagccacagcatgcaagtgcatgtttcagtctacaggcagagctggaggccgcttgctccaaaagagaacatccactttactttcttaccttgctgcatccacaagagggagcctcgtgccagcttctccagccaggatggtagcccccaagactcttcctcttccatccacctttaggtgcagcatccaacaaggtcaaaatcacaatgtcttgcatctaacaaaaaattaccaggcataaaaaaaaaaaaaaaaaaaaaacaggaaaatatgacccttaatataaaggaaaaaaacatgaaaaacaacccagaaatgacacagactatagaattagtggaaatagttattataattgtatcctatatgatatatagtgtatatatatatgtaattgatatataattgtatcaaaaatttagaagactgaacgtgttggtagatctatagaagatgttttttaaatacccaaattgaacttctgaaattaaaactataatgtctaacatgaaaacacattggatgagattaacagcagattagacactaagaagaaaagatttgtgaacttaaagacagcaataaaagccatccaaattgaaatacaaagagaaaaaaaaaaatgaaaagaaacgagaagagcatcagggcattgtgggacaacttcaatcagtctaaaaaatgaaaagatgcttccaaatgtaaaaaagaatcctttaaattgtcaaagagcccatcagaatttttaacagctctattagaaaaaaaattcattttgctgcttaagttccagcaggccaatctttgtgatgaatcccttgggatgttgccaatccagacaggcagctcttaaggtgacataccagtcatccagggacttaccatcatgtcagtcattttgttactgtttttaataatgtaaaatacttgaccaatgaggattccttccagaaatgcaaaagttatccaacaataggaatcctatctacacaaatcattacatttataaagaagaaagcccacatgattttatgaattaatgtataaaggtgtttctctaatatttaacagcattctaataaaaagtttaactaacataggaatagacagaagctacctaaacaagacgaaaactgtttaccaaaacagaattctatttttaatcatgatggaataatagagactagaagtaccttccctccttgcacaactaaaagctggacaaaatatatcaagtgaaagttttcagacattggacaacaggcagtgcaagactgtgatccctgagagaaagacaagtgagatgagcctgcaagtacccccagctcactgcctggagaatttccaggctgatcacagaaaaaagaaaccaaaacaggagtccaacagtctcactgattaaggagacaaagttcagagttccagcagggcaaaatgagaaaaatctgtgaggcaaagtatcagagaaaaagtactgcagagagtgagggttccagagatcttcagagcagtccctcaagacttgggctgagtactgctatgtgcttgtgtaaggagactactgaggctggggaaagaacagcagagaagagtaggcagaacaatttcaggagttcacacaggaccagaaatagtgttttccctagccggtttgggaagatctcctaatacggtggggcattgggtacagttctcaaaagcaaattgcctcagtggggccaaattagccctcagtgtaaaagtaaagtacctaaagggatgtttagaaatccagcacccaataacataatgtgtacaatgtctggcattcaataaaatattacctagtatgcaaataagcaggaacataagacccagtaccagaaaaaaaaaaatcattctataaacatagacctatatatgactcagatgttagaatttgtaggcaaggacatcaaaacaagaattataaattcactccatatgttcaagaagtacaagaaagcatgagtatagtcgggagaaaaatgaaatgcctaactaaacttctagaaatgaaaaatacaataactaagctgaaaaatacattggcaggattaacagcagattaaatgctacaggagaaaagatttgtgaatttgaagatatagcaataggaactatgcaaattaaacattgagagaaaatataagccagaagaaaactaaacaaagcatcaataagttgtgggacaatatcaagtagcctaacatatacataactggagtatccagaagaggggaggaaaataatacttgaaaaaaatggccattttttttccaaatttaatgaaaataaacccacatgtattagtcagagttctacaaagaaacggaaggaataggatatatatatatatagtatttatattagtattatactatatatattttatacatataaaatatattgcaggtgtgagccaccatacccagtatatgtattatttatatatgtaaatatgtagtattttactaatataaatatattggcaacatataactatatttacatatataaatatattagagggagagagagatttatatgaagaattggctcacacggttatgaaggccaaaaagtgccatgatctgccatctgcaagtcagagacccaggaagaccagtgctgtaattcagccagtggttgggtccatccagaagcactctcatggacacagcaaaaattatgtttaacctgtgcaccccatagcccagtcatgttgacacataaaatttattatcacaagtctaccctttgtcaacttggcacccatacacatctcctcaaaccaaacttattctccaaataaaaataataggtcataattccacctaccttaatactaccctggatacaataaaaaacacagtaacttatttcccagatgaggaggtaaaatccttgaaacatgtttactctttgatatactataacacttggctgggtgcagtggctcacacctgcaatcccagcactttgggaggccaaggcaggcagatcacttgagctcagaagttcaagaccagcctgggcaacatggtgaaacaccaactctataaaaaaaaatacaaaaattagccaggcacggtggtgtgtgcctgtagtcccagctacttggaatgctgaggtgggaggatggcttgagcccaggaggcggaggttgcagtgagccaagatcgtgccactgtaccacagcctgggtaacagagccagactctgtctcaaaaaaaaaaaattaaattaaaaatacttaaatactatgatataaaatattataaatacaccttatgttacatgataagggaataagagtggaaggataacaaagattcacacacaaatgtgtttacagcaaaataaggagaaaatagacatggcaattaccatctttgtttctgtaactggccacatggtcatggctggtatttacaactaccttttcccactacccattctgtattcccattgccttcagcaagtacctcagctttatctggtagggtgacttcaacttttattcctgaagggtttgagccatttgtagccctgcctggtcgggctgtagttttctattgacataaaacacagggcatggtaatactaaagataccctaaggaatttcctgtattctggatatacttactcttccttaactccattgtggaatagtagtccaatttcccccttggtagtcaggaccaatcatcccagccaacactgtaactcccttctttacctattaattgagaaatatgaggatcccaaagtggccaggtggaagtcttaactttcagttcttgggatcattattgtgtctcctggtggaaatatcccttccttatggaaatatcccttcctctagaactaagaactctaggtcagcaaagcataaagtcaggaacaggaaacaaaaattttgctagtgggtcactcggggtaatagtgagtggtgccactcccacttttgtcttttgatctcttgacctgtgaatgctacttgctgtaggagaaacaagatcttatattggacactgattcatagcatatacagccttctgaggaacttcactccacccctgcaagaaattgccacctagctgatgtcataactgagacttcaaaatgctattccactgttttatcaagccaattgcttcaggatgatggggaagataatcagaccagcaaattccacgagcatgggtccgttgctctgtttcttttgctgtaaagtgagttccttgatcagaaacaatgcaatgtggaatactacaatgatgaataaagcattctataagcccatggatggtagttttggcagaagcattgtgtgcagggaagacaaaacaatatccagagtaagtgtctattacattaagaacaaacagtgtcccttctatgatgaaaatgtccccacataatcaacctaccaccaggtggctgtgtgatcaccctagggacttgatgttggtctctgctcaatgttggccatatcagggactcaatgttgctctctgctgttggcagattggactttcagcagtaactgtaagccagattggccttgttgagtggaagtccacgttacttccccaagcataaccgctatcactgccatcatggtcactttgttcatgagaccattaggcaatgacagaggtagctgggaaaaaagggtgaccagtatccacagaatgggtcatcttgtccacttgattattaaaattccctttgtgagtattcacatgggacacaaatatcaccatgtgttttgcccactcagagaagtctgtccatatacctcttccttaaatttgtcaccaattttccaatcatgttcctctcaattccctgaacatccagccaaaccattggccacagtctgtactgatatataatcacaggtctggccatttcttcttccaataaaagtgtacaatcagatgctctgctcaaagttctgaccagtaagaggatttcccttcacagctgtctttcagggatatcccagtaagaggttctagtactgcagctgtcgtgtctgcatattgtgcagaaccatctgcaaaccaggcctgagtcttctcctatcgattgatcatagggaactcctggtaacaccaaaggtgcaggcagtgagagagaaggcagtgttgcaaaagtagataccatgagcatttgggtcactttttcatgtaacttacatgtgccttcagggcctattccaaccagatcatgtatgtactatttccatttgatgatggagtgctgtgtatgccaaattttatgacttggtggatcagataacagtcagttcatgatgggcagctcaggttgcatggtaacttggcagccaatggtcaaacattcagtctctactaaggcccagtagcagaccaagaattgtcttccaaaagacactcctgcaagaatggccataataaaaaaaacagtagtcgttggcatggatgcagtgaaccaggaacacttccgcactgctggtgggaatgtatactagtacaaccactatggaaaacagtgtggagattccttaaagaactaaaagtagaattatcatttgatctggcaatcccactactaggtatctacccagaggaaaagaagtcgttatttgaaaaagatacttgcacatgcatgtttatagcagcataatttacaactgcaaaattgtggaaccaactcaaatactgatcaatgagtggataaaaaaaactgtggttttttatacgtatacatatgtgcgtgtgtgtgtgtgtgtgtgtgtgtgtgtgtgtgtgtgtatgatggaatactacacagccatgaaaaggaatgaattaacagcatttgcagtgacctggatgagactggagattattattctagtgaagtaactcaggaagggaaaaccaaacatcatatgttctcactgatatgtgggagttagctatgaggatgcgaaggcatagaatgatacaatggactttgggggcttggggagaaaagtaggagggggtcaagggataaaagactacaaatatggtgcagtgtatactgctcgggtgataagtgcaccaaaatctcacaaatcaccactaaataacttactcgtgtaaccaaataccaccagtaccccaataacttatgaaaaaaaaaatttttaaagataagacagcaatagccaagtgggtttcataccagggatgcagggatatacaagtcaataaatgtgatattatgcccagtaaacagaattaaaaacaaaaatcatattattatcccaatcaatgcagaaaaagcatttgacaaaattcagcattgctttatgattaaaaccctcagaaaaattggcatggaagggacatacctcaaggtaataaaagctatctatgacaaaccgacagctaacatactcaacagggaaaagttgaaagcattccccctgagaactggaacaagccaaggatgctcactttcaccacttctattcaacatagtactggaagtcctagccagagcaatcagacatgagaaagaaataaagggcatccaaatcagtaaagaggaagtcaaactgttgcagttcactgatgataagattgtatacctagaaaactctgaagactcatccaaaaggctcctagattggataaatgaattcagtaaagtttcaggatacaaaaatcaatgttcataagtcagtaacaccactatataccaacaacgaccaaggtgagaaacaaatcaagaactcaatcccttttacaacagctgccatatatatatatatataaaatatattatatatatgtataatatatatattatatatattcagcatcgctttatgattaaaaccctcagaaaaattggcatggaagggacatacctcatggtaataaaaactatctatgacatatatatatatatacacacacatatatccaaggaggtaaaagacctctacaaggaaaactacaaaacactgctgaaagaaatcactgatgacacaaacaaatggaaactgacatttgtatatatgtatatatacaaaattagccaggtgtggtggcaggtgcctgtaatcccagctacttgggaggctgaggcaggagaatcgcttaaacctgggaggcagaggttgcagtgagccgagatctcaccattgcactccagcctgggcaacagcctgggctgtgtagtattccatcatatatatatatatatatatatatatatatatatatatatatacacacacacacacatacacacacacacacacatgcacacacacacgcacacacacacacacacatatatatacgtatatatacaaatggaaacatgacaaaactcatggatgggtagaatcaatatggtgaaaacgcccatactatcaaaagcaatctacatattcagtgcaactcccatcaaagtaccatcatcattcttcacagaactagaaaaaaaattctaaaattcatatggaaccaaaaaggaccccacatagccaaagcaagactaagcaaaaaaaatctggaggcatcgcattaactgacttcaaactatcctacaagatttataccagtaccataacagcatgataccaatataaaagtaggcacatagatcaatggaacagaacagagaacccagaaataaagccaaatacaaccaactgatcttcaacaaagaaagcaaaaacgcaaattgggaaggggcaccctattcaacaaatggtgctgagataaccggctagtcacatacagaagaatgaacctggatcctcatctctcaccttatacagacatcaactcaagatggatcaaagacttaaatgtaagacctgaaaccacaaaaactttagaagataacattggaaaaactcttctaaacactggcttaggcaaagatttcaagaccaaaaacccaaaagcaaatctaacaaaaacaaaaataaacagatattacctaattaaattaaaacacttcggcacagcaaaataaataatcagcagtgtaaacagacacctcaccgaatgggagaaaatattcacaaactatgcgtcctacagaatctacaaggaactcaaatcagcaagaaaaagagaaataatcccatcaaaaagtgggcaaagaacatgaatagacagttctcaaaagaagataacgaaatgactaacacatgaaaaaaaatgctcaacatcactaattatcagggaaatgcaaattaaaaccacaatgaaataccaccttacttctgcaagactggccataatttaaaaagtcaaaaaatagtagatgtttgcatggatgtgatgaaaagggcacttttacactgatggtgggaatataaactagtacatccactgtggaaaactttatggagattccttaaagaactaaaagtaaaactaccatttgatccagcagtcccactattgagtatctacccagaagaaaagaagtcatcatatgaaaaagccacttgcatctgcttgtttataggagcagaattcacaattgcaaaaatatggaaccagcctaaatgcccctcgactgacaagtggataaagaaaatgtgatatatttacaccatggactactactcagccataaaaaggaatgaagtaatggcatttgcagcaatttgtacgggagttggagaacattattccaagtgaagtaactcaggaatgggaaaccaaatatcatatgttctcacttataagggtttgctaagctatgaggacgcaaaggcataagaatgatataatgtgccaggcgcagtggctcacacctgtaatcccagcactttgggaggccaaggcaggtggatcatgaagccagaagattgaaaccatcctggctaacatggtgaaaccctgtctctactaaaaatacaaaaagtagtcgttgtggcacgtgcctgtagtcccagctactcgggaggctgaggcaggagaatcacttgaacctgggaggcagaggttgcagtgagctgagattgcaccactgcactccagccagggtgacagggcaagactctgtctcaaaaaaaaaaaaaataaaaaaaaaaatatatataatggactatggggactcaggggtaagtgagaggagggtgagggataaaagactatacactgggtacagtgtacactgctcaggtgatgagtacacaaaaatctcaaaaatcaccactaaagaacttatccgtgtaacaaaaaatgacctgttccccaaaaactattgaaatttttaaaaatgtaaacgttagccatgcgtgttgatgtacacctgtagtcccaactacttaggaagctgtggcaggagtatctcttgagcgttggaggtcaaggctacagtgagctatgattgcaccactgaacttcaccctgggcaacaaagtgagaccctgtctcaaacacacacacacacacacacacacacacacacaaactggttttgtcctggtacctgattattataatttgaagcagaaattattttgtttagattttttaatattaagaagcatctcggccaggcgaggtggctcacacctgtaatcccagcactttaggaggcccaggtgggcagatcacccgaggtcgggagttcaagaccagtctgacaaacatggagaaaccccaactctactaaaaatacaaagttagccgggcctggcggcacatgcctgtaatcccagctactcaggaggctgagacaggagagtcacttgaacccaggaggtcaaggctgtggtgagccgagatcgagccattgcactccagcctgggcaacaagagcaaaactcccgtctcaaaaaaaataaataaataaaagcatctctactcacgattgaactatacaattaaaaggtcacacctttgtttcaccatggtaggcaaggtaaatattaaaaaagaaaatggctgtccataaaagggatctggtgacagaggatagcctctcccagggtaacaggcatccaggactccactccatcaacgatttctaaaacaaaggttgtgagcaagtgctaggatgagacgtgtgattaagtttctgagctgacagcaaatttaaaagatgccctcccagctcctggctgcggcccatcctccctctaaggtgcacaactccattatgcttttaactgatgacactacctcttggccattaccacctcccaccagatcccattcactttgttttaccagggaaagatctgctccagctaatgctttatccttcacagtgattttctttgactttatagaaagggagagccatttggtcaagaggctgcccatcagatcctgtgtccttctgcactgctaatatctatctgtggccctgctttaaaacccaaatacgaacatctcttccatgaagcccttcctgattgccagtgccctcaacagtgggataaactgccaggcatcttggagatctagacccgtggttctcaatcccgacttcccccggcctcctgagaagcttttaataggtgcatcagccctggattcttaccagtaggtctgagagggaggcttagcgcttgtgttcttttaatagtgtgcacagggttgacgggaaacacacacacactgtgcagaaccattccacgaggctgtgtgtccggaattggttccctccaatgggttcctggtgccgctgacttcaagaatgaagccgcggaccctcgcagtgttacacttcttaaagacggtgtgtccagagtttgttccttcagatgttcagatgtgtcaggagtttcttccttctactgggttcgtggtctatgcacgacttcatgagtgaagccgcagacctttgcagtgagcgttacagctcttaaaggtggtgcgtccggagttgtttgttcctcccggtgggttcgtggtctggctgacttcaggggtgaagccgcagaccttcacagtgagtcttatagctcttaaagccacagtgagtcttatggcggctccagagttgtttgtttctcatggtgggttcctggtctggctggcttcaggagtgaagctgcaaaccttcaccatgagtgttacagctcataaaggtagtgtggacctaaaaagtgagcagcagcaagatttattgcaaaaggggaaagaacaaatctcccacaatgtgggaggggacccgaacggggaagctggccgcgatggccagcctttattcccttattggccccgcctgcatcctgctgattggtccattttacagagtgctgattggtccattttacagagtgctgattggtccgtttttacagagtgctgattggtgtgtttacaaacctttagctagacacagagtgctgattggtgcatttacagtcctttagctagacagaaaagttctccaagtccccaccaattagctggacacagagcactgattggtgcatttttacagagtgctgattggtgtgtttacaaacctttagctagacacagagcgctgattgatgcttttacaatcctttagctagacagaaaagttctccaagtccccaccaattagctggacacagagcactgattggtgtattttcacagagtgctgattggtgtgtttacaaacctttagctagacacagagcgtagacacagagcgctgattgatgcttttacaatcctttagctagacagaaaagttctccaagtccccatcagacccagaagcccagccagcttcacctctcagtagcttacagaagaggaccccgctgccacagcacaataccacaaagaaagtcatgcgctcctcagcaggaagcccccttctccgggacagggactttgtttccttctcagctctattgccagcacctagaactgtgcccacctgtcagatctgttatcagatgggaacgtggcagatttgttgaatgaatgaaggaatgaatgaactatgtgacactcaaacttagccaccaaacttaaactagaaaaactgggttgtggtccctgatggaccgttggtgccttcttcctttgctggacggtgatctgtggctgtttctccggtgtgttcgcagtggttgcctggcttggtaacaaacactcttcagagccacagcctgtgctcgggctcctcgccgcctcccaggccctgcgatctctttgcatcccaggaggtcccggttggttgcagtcctcctgggtgactcaggaaccagcctctcctgaagcacacagcctagggagttcctggggccagagacatctccaagggaaggtcaagggcctggaggatgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacaggtcagacgtcagtacccgcagggggcttgaaactggaggagggctcgaagggagagggagccccgccaaggagcggggctgtgatggagagggggttccgactcgcatgggacctgcgggggagggtacgcggacagggaggggataccgactgggaggggctcagggacagggatggaggctcctctaggggaggacgggaggggatggagggccctggtgtcgcagaagcccacctggggccccctccgggctgcggcaccgatgcgcacactactcccaccgcccccgagtgcctatgtccggctggccgcggccctggaatgaatattgctcagtcccccgcgagtcaggtctgccgcgttgcagggtgaggggaaggtgtgaagccccgggcctccgtctgccccgtgagtccgggaacgcgcgcccccgtggatgccacctggcccctgagctgtgtccagtcacagctcacatagctctgggcactggtaccccgactgcctttccttgttagctgcgatacacaaatacatgagccagatcctttcctgaggccaggaagcctggaatctaataacattgggcggtggataaagtcccccgatccagtgcttagcttccgttaatggagccatggatggaagcggatgtcaggcgcagtgggggagaaatttgcgggggtggccctgtctagggccagagaaacaacctctgaagcttagatccagccctagagggaagaaagatgtgagtttcagccagggaaacctagcactttaagaaatagaaaccctttcaaaatttgagggcaggtagctctcctaaaagttgcagaaatggccacttctttcacgttctcttcgactgctttctgccgtgtctgccgttttcctcctcccgcacctttttgtctcctagggtggcatagccttccaaacagatctgcctacagcattttacctgcaattttacactgattttatagaaaggatggcttattgttcatgagaaacgtgtactgtttttaaccagatgtgttatattttcagtataacctgggtgttgtgcagtgggaaattacggaaagaatcaggacacgtggttaggtaggggcccagtggcgtcagacttagctcttcgtgactgcgagcttcttggtttaataaggatattggctcgctctgttcctggggtttctgggaaaagatatggaactgaaatgaaggtttcattgaatatggcccactgattttacaagcagaggtgcctgagataagcaaaaggtgaggcatgacctctggctgtgcattatttgttctgatattacaggagccaagcattccacttccttctttttaaagagctttgatttcctctcacatcttcatgaagaaggaaacagtgcccccacttacttatcctcaggccacacctgttcccatttattccgtgagttcctcccgcacccttctggttgatgttggttgtgatggccgaggcgaagttattgaatctcacatttggcaccagttgtttctgtttctcatctcccccctaccttcagttaaacatcagctgctatacttagctgttcaaagtacagatgttaactgtgttgggtgtgatcaaaagattatctcttttcctcaaatgtaaaatgggtgaggacagtttcaccacacagagtcactcccctagccaaagtccttgctattgcaaaacattttattgtaagagaattaaagtcactagtgtgtcaactagtggtacttatagacacattccatatttgtttgtgtagacagatcataagacaaacactagattattcccagtatgagaccatactgaatatgaacaattagaggccacaggtgagtgctgtcctcctcacactttctttgaactcttaagcttctacccttttaaccagccagccctctccccgaaaccttcactgaggctagaaacaaacacaaagagactatctgaattttagcgaattttatctctcttttctgttctcttgtgtaaaaactaaatgaccacaaactacaccgctggaggaaaaaggaaagctaaaaggtctatcagccttctgtatgtgatgcagagttcaactgaatatagcaaggtacacacctgcattctccttgccaggacttagatatcataagccattatcttgctggttgttgaaatcgtaatggggctttatagagcacaaggcgatgtttgtaaacagcactgttcaggcaagattagaatccgtatttcaaaaatgaggagatggaaacagagatattgtgtatgtggtccagggttagccaggaattaaatggcagagccggagctcaaaccagcattccttccagaataccacagctgcctctggagtggtttttgttgttcttgttgaattttgtgatggaagattgtgatttgtttttcctgaacacttaatatgttttctgacttgaactgtcagaatctaaatttagaaactctcatttggtatatttcatgtccatctttgttccatataattacaaaaatatcttagagctgggtataaccttaaagattgtcaagtccaatcttgtggtttttcaaagaaaaaaaacggatttaaaaaaataaagcaagtacctcatgttgcttccccaaatctacttcattggagaattacagctaaaagcaatgttcagattattgctccttctgtcatgtggtctcttgagaatttgccaaatgtataaatccagtgacttattttgatgtactcttttggtttgaggtctgtgacagcaaacataacctccctgaatcccagcctgaaatgcctatgtaccttctgttctaactgtagccgttattatagtggctaaagttctaacttctgttctaactgttctcctggttccatgacaaacagagctttacttgtcttattcctagcacagtgcccatagcaggcatacataaaatgtggtcagtatgtcagataaacatctgaaaaagtatgacatgtcattagaagttcattcagctacaagaacagaaaaccctactacaacggcttaaacaagtaaggagtttgtttttctcagagaaggagaagtctggaggtgagaagcctgaggctgggaaaggggttccgatatgaactcatctgagacaggttccttgtgtcttcccgcaccaccctccttagcatggagctctcatcctcacttccccaagttgcagcagaaagacgggcagaggcatgctccagaagagtcttgtcttgtcttgtctttttttttcttttcttttctctcttcttttcttttcttttctctctctgtctctctctcgtctctttctttcttttgagatggagtctcactcagtggcacaatctcagctcactgcaacctccgcttcccagggttcaagtgattctcttgcctcagcctccaagtagctgggattacaggcgtgcaccaccacgcccagctaatttttgtatttttagtagagacggggtttcaccatgttggtcaggctggtcttgaactcctgaccttgtgatctgcccccctcggcctcccaaagtgctgagattacagatgtgagccgccgcgcctggcttgtccttctttataataaataataataataatagcttttctggtagcccaccccaaaagacttcttacatgtcattggccagaaccatatcacatacacactattaaaggtgagggaacctgagagaatctagtgttttagacggacacgatgccaatacatcaaagtaagaattttgggccaggcacagtggctcacgcctgtaattctagcactttgggaggtcaaggcgggtggatcacctgaggtcaggagttcaagaccagcctggccaacatggtgaaaccccatctctactaaaaacacaaaaaatcagccaggcatgctagcaggtgcctatagtcccagctactcaggaggctgaggcaggagaatcgcttgaacccaggaggcagaggttgcagtgagccgaaatcatgccacttgctctccagcctggacaacaagagcaaaactccatctcaaaaaatagtaataataacaaaataggaattttgttaataaggcaggggggagaatgaacattgggtaggcagctagcagcatctgccatagtgtgttttatgagtcgtagatcctatctctaaataggttgttatttgttttggttttttgtttgttttactaaaaagcaatgggtaatgcagtgggtctagaggaacttttttaaatggtagagtgcaaggaccactctgagaactgctgatgatgtaggtctgggctgggtctataaatctccattccggacgggcacgccaggtcatctgagggcaggtggttgcgggaatacattttgagaaacaccgaatgtcgggtagtttagcagaagtgcctttattttatttccgttagctttttgcctcactcctcttgaggatattactttattttttaattttctactttggtcaacataaatcaatgtatagccttagaagtcgttcattgtagaaggtttttattgagtttatactgagtatagaaccctagtggcaattactttcaatgctttgggttgtgtttttctgatattaccatatcctaaatagcatgcaaatacgggccatttcttcttctcttttccagttctgggtaacatctattgacatcctaccaagaaggatgacggtttgctcctttacacccccaccctccctctcaccttcacatccctttcttttaagttcccaatacggttatatcctaaatttttgatatgtcaatgtttggtgtgtatattattcccaactaaggcacatgacacaccatgatctttacattccccttcttgaccagtctttccccccaccccatggaatggggtgtaggaattgctacattttctttagttgtttgtttgagaactcatctccaagaactcatttcctggagccaaggaaactcatgggggccctctgagtgctactaattgcatggagctgttgagtggggaggaaaagccaggctgccatcaagaagcatttggggtaaattttctaagcacatctgaaaagacagagtctagaacctccacggtccctgtctgttgtgatttattttctcattctaaatacatacatacatacgcacttttttttctgtctaggccatctcttgtggaatacatatgtactttcatacccaattatgtacagtttttgtaattttacgcctttttcttaaagaaggctcccaaaagtgtctaagattcaggccccataagaggcggttgctttttgagcttgtgcccatttaagatgtcacttttcttccttcacacttgattgctggtttggctgggtatgggatattaatcagaaatcatttcctgtccgaattttgaaaacattgctctattttattctattttcttatggtgctgttgagaagctgatgccattctaattcctgatcccttgtattttgttttaatctctgggcatttgtagggttttctttgttgttcatattctgatatttcatgatgctgttatttaatgttggggtggggttttttggcagggagatacagggaggtatcagtcactgtcctaggtattttataggtcttttcaatccaaaaattacattcttcggttctgagtggttttcttctgttatataattttctcgttctttctttctgaaacttaaattacttagactgaatctgaaaatgggatctcttggatttgtcttgtgattttatcttttttattttaaaaaaatcccatgttttttagttctaataaatcttccaacactgctattaaatgtttacattctaccattacatttttaattatcaggagcttttattggcgagaggtgtggtcttctaaatggtttttacagtatcctgttctcatttcatgaatgcagtatcttctcttatttctctgagaatattaactcagtactttttctacattttaaaagttttcttcagctacctacaatgtctgtgtctattttcaaagtgacttttaatgttgcttttggcctgcctttcatgttggaagttttatacatgtttagggatgctgtgcgtcatctgtgagcatggtttgtaagttggctggcttcattgtagggtggttaggcagagaaagccttcttgatggcttatcgcctgtctctagtgctttctagtacatataatgggtttctctgtagaaagatctcatttctagccatttattcctgtttgagaaaagtcacataataacttagatgtatttattatgtcatctgcttaacagcagaggttcttgttgtaaggtggataggtggaggtctaggattcaaaatgggaaatgtgtccttgactctgcctccactttgaagttgctgatgttctccacattttcttttctattgaaaaagctctgagataccaaggaatgaaaactctttgaatacatgtacaactaatttactttttgataaccatttgcaaaatatcgattatattgggaaaacatttttctaatacctctagaatttgggacagaatttctgcccttgaaggtaaccctccaaatccatgcaatttttcccttgtacagccccacagtgatcatcaaaacttggagcagattcatctttttttttttttttccctgggaaaggtttagatcacgtgaagggaacagatactacgtttgataggaatggttcctgctttagcttcctaaggcctctcacttggaaagcctgcccattagaccctggattttttgctgttagcttttccttcttaggcgacttcaacaaagactgcaaactccctgacagcacgggcccaggcttgtcacctctgcaactccatcacccagaatagtgccttatgcataataggcacttgataaatgttagttgacttaaattgaccctattatctgttttaaactagcccttcctacctgtccccttgctatttcctctgtttctcttacgtctttttatgtcaccacctcttggatgatgctacctcattctcaaatctgatggtatggaatagctataagaaaacaaacttgaaagatatctaactactaggactctaagtcgaatttccaggattcaaaactcccatatcaccttactaaatatctaattatttcttaggttatcaccaaccaccctgcatcgagtccctcctgagccacagttcagtttggattatttttttcctcatgttccatcccttgactgtagtgcccttcccttccttccagtgtctttgatcggcctctactttgatccagagcttctctttgatctgttctaatggtcatttttctgcctcctcccctacattgatctacaatctggcatattttatacattatacaaagcacattgttatgctgatttcagaatacctacctgtcaatcagacagacatcttttcaaacctaactcagacccatgatgaaagtctctctcttctggccattactgagatagctcctgctctggtctcactggggctgtttatttctctatgggaggctttagaacagtaactaaactacagtgcaaaacagtgatctgtagattagtgtttcttaatcatcagcactaacaatagaatctaaactcccagggacctggagacttggctgagaacagcctgacataagtgcagtctctcttaatactaaaaaatttatgctaccccaaaatatgtctgtatctgttttcaaatgaaaatcatttttccagaatcttcaggtgaaattgatactccaggattatgttcatcttgtgatttcagatatcatctggggggagaggattcgcacatatgctagtctgtgagatacagtagtagaaatcaaaggacttacctagctctaagaactgtacgaaaatagtgatggtaccaacaattttaccaatggctagatttaggagatggtgttctcttgattcaagattaaggctaagctcatcagttcagttcagtttaagaactattattatatatcaagcttgtgctagtttatgatggagatgataaggtctctgctcttgaagattctgtagactaatgggcaagacatatgtcactatataattttaatataacatggtaagtgataaaaatcatggtatgtataaggtcctttgaaaacacacaggtggggcacttagcccagcctggagactcacagaggcttcctgcaggagataaggcctaaaaacagaaaccaagtaagaggaatgaaaaggacatgcaatttagaggggacaacatcagcaaaggggacactgtcaggttcacggtgggaagaattgggaggtgacgctggagaggagccacattcaggtatacacaatgcaaggggatgtggacccctccacaggctgctggttagccaatggaacattttccatcctccagtagggtagtcagatatacacggaaggtggatgactggctgcggggtggaagaagaattcatggacagcaggactagaggcctcacagtgtttaggaaaaagacaatgagagcccaaatgagatcattgctgcaggcacagaagggaaagagaaaataccaggatacttggggaagcaaatttagcagaattttggtgtctttgggggcaatggtgaggggagaagagtccagaatggctcccaggattctggctttctgggtgactggacgttaagccatcacccaagtttgggatatgagaagagaagccgatttggtggggaaaaaagatggtgaattcagtcttggacatactgacttgaggtgtctaagaaacatctgtatgtttatgtgcatgtctgtctattcagcaggttgttggatctatgagtctgagacttagagacaaggtcagagctagagatgaagttgtgggagtcaccagtgtgcaagtggtgattaatccatgggtgtgcatgagagttcttgcaaggggaagaggaaacggaagtaagggcttatgcaaggaggattgttgagtaaagtggaaggcccagcctctgcctgctcactaatgtcagtgctgaacaagcccactggcagtggatgctgagggaaggaaggaaggagtctgtctgtaagcttgagcactttttccaagaggtggagaaggcagagagcccaagccttgaagaaatgttccttagtggcctggcatctcggaaatttgactccatgactttggagtgatctttccattattattttccttgagcacccagaaagagaattctgaactaaatgtattctttcacatggctgagttaaggatagtgttaattactgaaatatatgtaaggttttttttttttttttggttgtttgaaaactaagcccacctttgaagtccagagatgtcctttcactctaatgtatgctgaggtggcaactggtaactgcttctttgtaggtaatagccatagccttagtttcatcctcctttctccatgactaaaacttgctccaacttctgcatttcgtttttatgatgtattaatgaggagcaaagacataaaggggtttcagaatttggaagagccatggagagtccctcttccaaactccctatttaacaaataaagaggccgggtgcggtggctcacgcctgtaatcccagcactttgggaggccgacgctggtggatcatgaggtcaggagatcgagaccatcctggctaacacagtgaaaccccatctctactaaaaatacaaaaaattagctgggtgtggtggcgggcgtctatagtcccagctactcgggaggctgaggccagagaatgccgtgaacccagaaggtggaggttgcagtgagccgagatcatgccactgcactccagtctgggggacacagcaagactctgtcacaaaaaaaaaaaaaaaaaaaaattaggaccctgagaggctatgtgtcttgctcaaggtcacagagtgaattcctagcagcattcaggctaggacccaggtattctgactcagtggccagtgttcttgttagatagtgagaaaatagaatttagtccaatttgtttttcaatctcgaattcaggatccagcaaaactgcctaattttcatgacagtttgaagaaaggcccaaatcaaatgcctccccctctgtgaggcctacccagtttctcaggtgagagttacccactttgtgtgctatgcgctaggactgctaccagtacgtcccaggacaatcagtctttcacaagtattgtcatgtggcacttaacgacagggacatgttctgagaaatgggttgttaggcgattttgttgtgtggacatcctagagtgtacttatacaaacccaaatggcatagcctactacacatctaggctatgcggtgtatactgtcagtactgagcatacgcactgttagcagatgctgaagggagtctgtaggcgtgagcgctttttccaagaattgacttcaaacctgtacagcacgttactgtaccacacactgtaggcagttatagcacagtggtaagtatgtgtgtatctaaacatggaaaacatgcattaaacatacggtattatggccaggtgcagtggcttacacctgtaatcccagcactttgggaggtggaggcgggcagatcatgtgaggttgggagttcgagaccagcctgaccaacatggagaaaccctgcctctactaaaattacaaaattagccaggcgtggtggtgcatgcctgtaatcccagctactggggaggctgagacaggagaatagcttgaacccgggaggtggaggttgccgtgagctgagatcacgccattgcactctagcctggacaacaagagcgaaactccgcctcaaaaataaaataaaataaaataattagccaagcgtggtggtgcacacctgtagtcccagctactcaggaagctgaggcaggaggatcacttgaaccctggggacggaggttgcagtgagttgagatcgtgccactgtactccagcctgggtgacagagtgagaccttgtctcaaaaaaaagaagaaaaaaaggtattataatcttatggggccaccatcatacatgccgtctgttattaaccaaaatggcattatgcggcacctgactgtatacagctctctactagattataaactccttgcagataaaactattcattttatcattatccattatattatttccttagcacccagaagaatcctgtatttaattggctcatatggaaaattttagaaagagagagacatcggggctcagactatcttccgatcaggaaccaaaacgagctgggaggtaacagagttctttttcatagtaattgtgttccatatcatggtgaaatcgtgccagaacaagcttcagactctttctggtcttactccttctgaccgtgctgttccaaagaacttcccatacaggaaataacaatgatggcagtagctgtcaaattctaaagacggggatagactctggacctcctcaggcccctgagcccactgtagagcagggacgtgacttaactgaagttcaggactgcggccacagtcacatccacctgtgagcaatggaggactttcaacacagaaccctctgcatcccctgcattctgttactaagcagctcatagaacacgaagaggtattaaccttgttatttgcagagttacaaaaagctgagtcaggtattccaaagcaaacccagaccagaagccacctgagagttcgtgccggcaaggacagattcagaatgtacaaaaacgatgaaaataatattctgtgatcaccctataacctacttccttactgaccaaacacatgtctcattcccattaaaaagttatgctcagccactgccctctctaggattatctgatgttaaacagtaattctgcccatttagggtcagctactcaaaagcaaagaacagcaactttaggtcaaaatatattcttccaggagagaagcccaagtctctcccctattattgcgggaatagtgtacgagcaccagactagagaggaagctaacacttattaaacatgtattctagtcagctgctagacattttcaggtaagcctcacaggacccctccaaggtggtattaatgtccctgttttagaaggaggagtactgagattcagagacattagagaacttgtccaaggtcttaccagtaaaagtggcaaaaccaggattgaacttaggtctgacactacatagttcatattctattatgtgactatattcctccttaaaggaaaatttaggaattcggtttcctttaggaagatgtaggaaatagaatgtactgaaactaagataacagttgacttaagtcttttctaactcagccttcctcaggcccatgtgtgagctggtttctatcctttccctgagactcttgggcacataggaccataatgtctgtttgattttacttttaagtatattcttttggtcagtcccagtctaacaaaattttaagatttaatgcattctatccatgcaagagaattacatgtggttttgcttgctaaagaaggtggaggccgggcgtggtggctcacgcctgtaatcccagcactttgggaggccgaggcaggcggatcacgaggtcaggagatcgagaccatcctggctaacacggtgaaaccccgtctctactgaaaatataaaaaattagccgggcgtggtggcgggcacctgtaatcccagctacttgggaggctgaggcaggagaatggcgtgaacccgggaggcggagcttgcagtgagcagaaatcgcgccactgcactccagcctgggcgaaagagcgagactctgtctcaaaaaaaaaaaaaaaaaaaaggtggaaatgatatagggtaaagagagtaagtgacattatctagttcactcccaccatatggacgattggctgcaactgcctctcagcctttgcatgtgttatttgctctgactagaactctgcccacactacctgactaatgcctgtgtgtttttccaggaagctttcatgacactaccctctataatctttctcctatttcctccaggctgagtaagaatcttccctttgttttcattgttatgagtgttgtctgtatactctagtaaattatttttatgtgaatcataatagtttaattaatcagtcttctgattcacagtttgagctggctataggcaaggtccttctgtaaagagttgatgaaatctacttttaagagtagaaggatagacaagatgccaagacaattcaatagggaaaaagaatagtcttattaacaaatggctgggacacttggatattcacatgtgaaagaataaagttggattcctacctcacaccatatacaaaagttaagtcaaaatagatcagaggtcaggtgcagtggttcacacctgtaatcccagcactttgggaagccaaggctgaatcacctgaggttagcagttctagaccagcctggccaacatggtgaaaccttgtctctattaaaaatacaaaattagccaggtgtggtggcacattcctgtaatcccagctactcaggaggctgaggcgggagaatcgcttgaatgtaggaggcgaaggttgcagtgagccgagattgcaccattgcactccagcctgggagacgagcaaaattcagtctcaaaaaataaataaatagatcagaaacataaatataagagctaaaactacaattcttagaagaaaacatagaagtgggttttctgacctttggttaagcagtggtttcttggatataacgtcaaaagcacaaacaaaagaaaaaaacagataaattggacttcatcaaaattacaagcttctgtgcttcaaggacagcatcaagaaaagacaactcacagaatgggagaaaatatttgcaaataatatatctgttaagaaacctgtatctagaacaaagaactattacaactcaataatagacaagtaatccaattaaaatgggcaatgtatttgagtaggcatttctccatgtgcccaataagcacatgaaaagatgctcaacatcactaatcattagggaaacaaaacaacaaaataccacttcatacccactagaatggctaaatgaaaaaagacataacaagtgttggcaaagatgtgaagaaactggaactctaatacattgctggtgggattgtgaaagggtctagccacttttgaaaagtctgacagtttctcaaaatgttaaacatagagttaccatctgaccaagtattccactcctaggtatacagtcatcaccctttatctgcaggggatatgttccaagacccccagtggatgctaaaaccgtggatagttagtgccaaaccttatatacactatgttttttcctagatgtatatacctatgataaagcttatataaattaggtatagtaagagattaacaataatagtaggactatattagaactatatgtgtactagaacaattacaacaatatactgctcacaatttcatggatgaagattcatttttactgtagatcttagcaacctcagcatactatttttttctttcgttattaagaactttcatgtttccacttaaacaaaacacttgacaacttctctttggcatattcaaactgccagcatcgctactttttcattttggagccattaggtaaaacaagggttatgtgaacacaagcactatgataccatgacagtcaacctgataatccagacagtttactaagtgactaatggttatgctggagaaagcgatgactcatatccagggtgggatggcatgaaatttccttatgctactcagaatggtgtgcaatttaaaatttctaaattatttgtttcttgaagttttgatttaatggttttggaccacagttgactgcaggtaactgaaactgcagaaagcaaatccatggataaggggagactactgcatatccaagagaaatgaaaacatctatacacacaaaaacatgcagttgttcacagcatcattattcataacaattcaaacgtccatctactaacaagtgaataaataaaatgtgacacatccacacaatggaatattatttggccataaaaaggaatgaagtagccgggcgtggtggcccacacctgtaatcccagcactttgggggccaaggcaggcagatcacgaggtcaccagttcgagatcagcctggccaatatggtgaaaccccatctctactataaatataaaaattaaccaggcatactggcgagcgtttgtaatcccaactactcgggaggctgaggcaggagaatcgcttgaacccgggaggtagaggttgcagtgagccgagaccacgccatgcactctagcctgggcaacagagccagattccgtctcaaaaaaaaaaaaaaaaaaaaaaaaaaggagccgggggcggtggctcacgcctgtaatcccagcactttgggaggccgaggtgggtggatcacaaggtcaggaaatcaagaccatcctggctaacacggtgaaaccccgtttctactaaaaatacaaaaaattagccgggcatggtggcaggcgcctgtagtcccagctactcgggaggctgaggcaggagaatggcgtgaaccggggaggtggagcttgcagtgagcagagatcgcaccactgcgctccagcctgggcgacagagcaagactctgtctcaaataaataaataagtaaataaataaataaaggaatgaagtgctgatacatgctataccatgaatgaatcttgaaaacattatgctgagggaaagaggctgcatcttgtatgatttaatttatataaactgtctaaattaggcaaatccacagagacggaaagcgtattactgattgccaggggctgggggtgctggcaggaaatgggaatgactatcaatgtgtatgggatttctttgggggttggtaaaagcattttaaaattgaatagttgtaattttatataaaattagatagcaataatggttgcacaactgttagtaaaccaaaaaataccaaattaaacaccttaaaaggataaattttatggtatgtaaattacatggtggatttttttttttttaagtagaagagtaatggcaataaagtacggagaaccatcttagggtgactttcagagccatcaggaaaaactgtcacagaaataaaaagtaaaaaaacttagtaaagttgttgaaatagttgtagcttgttatacacctgagagttatttttcacagtgatttagtaattaaatctataaaaggaaatgtgttaattggccaggcctggtggctcacacctgtaatcccagcaatttgggaggcccaggcaggtggatcacctgaggtcaggagttcgagaccagcctggcccgacagagggagactctgtctcaaaaaataaacagaaaaagtaaaaaataaagggaaatgtaagtgtgaattgatgaatggataaataacatatggcattatgggcagaattttgtctcccccacctccaagtgtatgtgatgaagtcctcacctccagtgcctcagaatatgcctgtgtttggagacagggtctttaaagaagtaatcaagttaaaatgaggtcattaggacagtaatccaatatgactgatatcctttaagaggaactttagggccgggcgcggtgactcacatccgtaatcccagcactttgggaggccaaggcgggtggatcacctgagctcaggagttccagaccagcctggccaacatggtgaaaccccgtctctactaaaaatacaaaaaattagccaggcgtggttgcagacacctgtaatcccagctactcaggaggctgaggcaggagaatcacttgaacccaggaggcagaggttgcagtgagccaagattgtgccactgcactccagcctgggcaacaagagcgaacctctgtctgaaaaaaaaaggaactttagacacagacacacacagaaagaagaccatctgaagacacagggtgaaagcggtcatctgcaagcccaggagagaggcctcagaagaaacccattctgccaacgcattggtctcagacttccagcttccagaactgttagaagataaatggctgtggtttaagtcccccagcctgtgggcctttgttacagcagccctggcaaccagtacagatttgggtaccaagaaatagggtgctggtgagcagacgtggctttggaactaaacagtgagtaagggctggaagagtttggaggtgcatgttggaaaaggcctaaattgccttaaagagactgttgatagaaatgtggacattagctgggcgctgtggctcacgcctgtaatcccagcactttgggaggctgaggcgggtggataacttgaggtcaggagttcaagaccagcctggccaacatggtgaaaccccgtctctactaaaaatacaaaaattagccaggcgtggtggcatgtgcctgtaatcccagctactcaggaggctgaggcagaagaattgcttgaacctgagaggcagaggttgcagtgagctgagatagcaccaccgcagcactccagcctgggcaatagagcgagactcaaaggaaaaaaaaaaacaacaacagaaatgtggacattgaaggtgattccagtgaggactgagaaagaaagaacagagctgtagagaaagcacctatcagctgggcaccgtggctcacacctgtaatcccagcactctgggaggccaagacaggtggatcacctgaggtcaggagtttgagaccagcctggccaacatggtgaaaccccatctctactaaaatacaaaacttagccaggtgtggtggcatgcacctgtagtcccagctactcggggagctgaggcaggataattgcttgagcccggggggcagaggttgcagtgagccaagatcatgccactgcactccagcctgggtgacagagagaaactccgtctccacaaaaaaataaaaataaaaaaggaaaagaaaatgcgtctatcatcttagagaatacatgtatcatcaggaacagcatgttggttgaaatatgaatgttaaaggtacttctggtgagaacttggacagaaatgagaacatggtattagaaactagaagaaagatggaccttgttatacagtggcaaagaaatttgttgaattggattctcatgtttcatggaaagcagaacttataaatgatgaacttggatatttagctgaggagatttctaagcaaaatactgaaggtggcctgatttcttcttgctgctcatagtaaaatatgaaaggagagagataaactaaaaaaggaatttttagaaaaaaaggaaccaaaacttttggaaaactctcagtctatccattctacaaaaaatgagaaagcacattctggagaaaagaccaagggtgtggctgaacccccatctgaaaagatggccaatgtgatgcatggatacagtcaaccaactcagcaagtcgggaacagagatgtggttttcccaggaacttctgtggagggccctcttgtcaaatggcctcgccccctatggattgcataggaggccaacaaggtttttcagaatttataccagcagacattgccagtttggaccaaaggagacagaaataggaagaaatgaaggaagattctcagacttctggaattctgcaggaccagccagtacagcgatatggctatgatcatgagttatccttaaaggaaagagaagaatgaccctgaagctagttcagagatctgccaggttgctactgccaccttgggcccagggcacacagattcaggggcaggactggtgccatttccttggtttcagcaggccaggatgccccagcccaggaccaaggggtggggccaccatttagggtagaggaatcagggtgatggccctggaaggcagggccaccctgtggacccagacaacagaacactgagccaaaaaggattattctcaagccttggaattgggctgggcgcggtggctcacgcctgtaatcccaacactttgggaagctgaggcaggtggatcaggagttggagaccagactgggcaacatggtgaaatcctgtctcatataaatagccttgcatggtggctcatgcctgtaatcccagctacttgggaggctgaggcaggagaatcacttgaacccaggaggcagaggttggagtgagccaagatcgtgccactgcactccagcctgggcgacaagggtgaaatgaaactgtctcaaaaaaaaaaaaaaattgaacggaatttgccctaccaggttccaggacaggagatccatgaccactttcttctttccaatgtcccacttttaaactagaaatgtctatactctgcctgtcctgtttgggaagcagataatttcttgtctggtcataaaggttcacagctggagaagaattttgcctcaggatgaaccatacctcaaatctcacccatacctggtttagacgatacttacatgagattttggacttacagttgatgctggtctgggttaagacttctggcactgttgggatggggatgagtgtattttgcatatgagaaggacatggattttcagggagcagaggacagggtgttatgggctgagtatgctctctccaaattcaaatgttgaagtcttatctcccagtacctcaggatgtgactcttttgagataagatctttaaagaagtaattaaattaaaatgagatcattagggtggggcccaaatgcagtatgagtaatgtcctcataagaacacagacacacacaagaggatgactatgtgaggacactgagagaagatggccacctccaagccaagaagagaggcctccagaactgagaatgtaaatgattgtttaatctgcccagtgtgtggtactgtcttaccagccctagcaaccagtatatgtggtgtacccacacaacgaagtaccattcagccatcaaaaggactcagtgctgattcatgcttacaacatggagaaacctgggaaatatcgtgccaacagaaagggccagtcacaaaaggccacatattatataattcaatttatgaattgaaaggcaaacctgtagaaatataaaatgactggtggctgcctgctggacaccctgcaatgcacaggacagccccacaacaaagacccctgtggcccagagtatcagcaatgccgaggctgtgagatcctgctctcacccaggcctgcttcccaaagccctttagtcctgaagagagaagagaacaggctgccttctttctttgttattgaaatcccacttactccctcttagagcatgttcttctccctttaagaccagccttggctggtctccaccacatgtagatggggctggggaaggagaagactggtgagagtgaggggtttcttttcctttttttttttttatgttttgagatggagtcttgctctgtctcccaggctggagtgctggagtgcagtggcgcgatctcagctcactgcaacctctgcctactgggttcaagagtttctcctgcctcagcctcctgagtagctgggattacaggtgcccaccaccacgcccggctgatttttgtatttttagtaacagacagggtttcactatgttggccaggctggtcttgaactcttgacctcaggcaatccgcccgcctcagcctcccaaagtgctgggattacaggcatgagccactgcactgggttttgtttttttgtttttttgttttttttttttttgagacagggtctcttctgttgcccaggctggagtgcagtgacataatcatggctcactgcagcctcaacctcctgagtagctgggactacaggcatgcaccaccacacccagctaattttttttcttttcttttcttttctttttgtttttttgtttttttggtagaaatggagtttcaccatgttatccaggctagtttctttctttcttttcttttttttttttttttgaaactaaatcttgctttatcacccaggctatagtgcagtggctcaatctcagctcactgtaacctctgcctcctgggttcaagctattctcatgcctcagcctcccaattagctgggactacaggtgcccgccaccatgcccagctcatttttgcatttttagtagagatggggtttcaccatgttggccagcctggtctcaaattcctgacctcaggtgatccacccacctcagcctcccaatgtgctgggattacaggcgtaagccaccgcgcgcagcccccaggctagtcttaaagggagaagaacatgctctaagagggagttaagtgggatttaaataacagaaagaaggcagcctgctgtcttctcccttcaggacttaaagggctttgggaagcaggcctgggtgagagcaggatctcacaggctcgacattgctgatactctgggccacaagagtcttggctgtggggccatcctgtgctttggaggatgttcagcagtgtccctggtctccactcagagaagccagagtgccaccaccagtccccgttgtgagccattggactcaagaatgacctaatggcttaaccttgtactgtgacagagcctgagttgcctgaattttaatgatacaaagaattttaattatactaattttattttattttaatttttttgtgagacggagtttcgctcttgtcgctcttcttgcttgtctcgccaacatctcatgaaaaaccttctaggacagctgggatacctccaattcattctttttaatggttatatagcatctcatagtaaagataaaatataatttattcattcaaacacgtggttggaacttgagtagaggcccaagctctctggggtatttgggatctatatattttgtgtctgccgccacaaactgggagacatttgctttaactctccacctgtgggagcaacgtaatgttagagagtgctggttgccaagcctaggcactcgaggagaaaaacaaaattcaccttccccctttttctgatccttccattcatctggacatctcttctttcaccatttcctgctttcccccctctaaaataagggaaaattactgctttgtttttttaaagcaccgtatcaagttttacttttaactacagccaaatggcatcaaccataatttctcctttccttggcaccatttcctctctcttcttctgtgcctctgcttccctctggtttccttgctcctcattctcccttactcttgcctccattttctctttctgactccttctatcttatcttctatttcacttatctcaaatgagagagagagagagagaaggaaggagagagggagggagggaaggatccaatgatctccctagatatgaaataaaaaggaacagttgcccaaacctccagtcttcttggttgccagcttggttgctatttttaatactaggccatagcagcaaatcagccagggatttaatagggagattctagaaatgagagtcatggaagtgttgagatgaggtcttcacacatccctagctgactgaaaaagctatgcatctatggggaagacctgagacagcacagcagaaagtgaaaggcaaagttactacttgtccaaaacattcaatcctcccctcacactcccatcatatctcatgtgaaattaaaaaaagaggaaatatattgaaataagaaagttggggaatttgcctttgtgaaagcacttatttttttcctttggagacagggtctcactctgtcacccagcggtggagtgacacggagtgtcagcggtgcgatcacggctcactgcagcctcaacctcacaggctcaagcaatcctcccatctcagcctcccgagtagcttggactacggcgtgcccttccatgcccagctaatttatttttagtagagacaggggtctcactatgttgcccagactgatcttgaactcctgggctcaagcaatcttcctacctcagccttccaaagtgctgggattacaggtgtgagccactgcacctggcctaaaagcattatctgatatttgttttcctattcgtaagtttgtccttagattgaaaggttttattgtatattgcacacaccagttgtgtatattaggaaacattccttaagtatttttttatttaacatttattttatttaaatgtttttaatgctaaaccacagcaggggcttagcctatatttggaaaatgggttatccaaattatttagaagtccaaatttttattgttctacttgaagttatttattaccttgttcctcctgtaactaaaagtgactcatcctccatctcctccacgtgttccataatgtagctaatctaatgaactaatccattaatttgttaatggaagaaatatagcccatccccatcaaatcaaagtactcagtcttctatgaatcatacataagtttaaataaatttctacagacatgctgcaggccctgctgtccactggtgtgaattttagacgaggtgaaagggaagggtgggtcttgacaagccggtatcaagtacacagaggcagacaaggactctgcctttatttcaggcactgcttttgagaaaaatgaggcagggcagggaggagggaagccggttagtcagtgtgcaattttgacatacatttgcaaagctggtttttctgcacctttgcctaggaaaatgaagtataacgagcttgatattgaaagggacctgtgttaaacattaaacaaaaatgtaaattttttatgttcaaaggagggtttaaaaaaaaagcaggctgggcacagtggctcacgcctgtaatcccagcactttgggaggccgaggcaggtggatcacttgaggtcaggagtttgagatcagcctgaccaacatggtgaaaccctgcctctactaaaaacacaaaaaaattacaggcatggtggcgcacgcctgtaatcccagctacttggaaggctgaggcaggagaatcgcttgaatctgggaggcagaggttgcagtgagccaagattgcaccattgcatgccagcctgagcaacaagagcgaaactccatctcaaaaaataataataatgaggagaaggccttccagttatggcagcacaaagaggcaggcaatttctttctgtaaaaaaaaaaaaaaaagcaacaaccaaccaaaaaatatataaaactagacaaaattatttatcaaaaccaaccatttcaggaaactggaaattgacaaaatgcaggcaaaaaattgagcagcatttattcttgaaaaactactagatctttaggcaagtaggagattgtggctttttctgcctgtggctgctcccgtcaccccccagctcagccaatgacttttaagtaagatggggctgaccatgaaaactagtagctttgctgccatacaaacagattcaattcagagcagtggctggggggttgaaaatccttggctttgttggcttaacatgggaatgaacacttggaaatgagcaggacaaatccacagcttcgctagcttgaggttgcagccccacttggggcaagcagcaggccaaccaggaatttaacaggcggattctggaaatgagaatcagagaagtattgaagtgagctcttcacgcatccctggctgactgaaaaaactatctatgcatatatagagaagacctgagagagcccagcaaaaagtgaaagacaagggggacttgaaaactggccttctccaagccccacacagatcaactaacaggggctggaaatgcaatgggcttgaagtttttttttttttttttttggagatggagtctcactctgtcgcccaggctggagtgcagtggcacgatctcagttcactgcaacttccgcctcctgggttcaagtgattctcctgcctcagcctcccaagttgctgagattacaggcgcccactaccacgcccggctaattttttgtatttttactagagacagggtttcaccatgtttgctaggctagtcctgaactcctgacctcaagtgatctacccgcctcagcctcccagagtgctgggattacaggcatgagccactgcacccagcctcagagaattaaagaaaactgttcaaggaattaaaagaaaatatgatttaaatgacttgacaaatagggaatctaaatagtgaaatacaaactataaaaagaattaaatggaaattctggagttggaaggtacagttaccaaaattaagaattcactagatgggctcaatagcagattttcagatagtggaagaaccagtgaacatgaaaatagaccaatagaaatgatccaatttgaaaaacagagagaaaaaaatgaagacaaatgaacagaccttcagacacacataggatgatgttaaatgtccccacatacatgtaatgggagccccaaaaagggagagaaaaaaatattgatgaaaaatattgaattgcagatttttttaaaaaaagctcaaccaacactgacttttaaaaaacagaaagagaaccatacagtaaggacaaagccagaagcatcacacttcctgtgttcaaattctattataaagctatagcaatcaaaacagagtactggcataaaaacacacatagagcaatggaacagaattgaaatcacagaaataaacccactcatataaggttaactaatcttctacaaaggtgtcaagaacaagaatgaggaaagaatagtatcttcaataaatggtgctggaaaaaaggacttcttcaatctaataaaggcacctgaaagaaaccaacagcttatgtcagaagaaggacacagaaacttgatgttatatccatagaaattacaaaatctagagaacaggagaaaaaaatatgaaaaaattaatagcctcagtgatctttagaaaaatatcaaaaggtacaaaatgtgtgcaattggagtaagagtgaaagaagaggagatataaatattaaaaagcatggataaaaacaatattttttaaaaagcctaattaaaaagtatattgaaagatataaaaagaatttcagaaaaataatctgtagaaaacctacctaggcacatcacagtcaaattgtccaaaactagaaaagaagacaaaatcttcaaacagccagagaaaaatcatacataccaggaacaacaacatgaataatgataatttttccttttaaaaaagcgaataccagaagagaagggaactgtagctttaaagtgctacaagaaatagaaaaagtaaacccagaatttgatataaaatattcagcaaaaaattaaaataccacagtaaagttatctgaatataaataaaaattaaaatattcattggcagtagaactacatgatagtaaatggcaatggaattctcttaggtaaaaaagaaataataccagttggaagcttggattgtgaggaagaaatgaagagcacaagaagtagtgaaatgtagtcagatagtaaagagtcttaggtcgagccaccgcggctcaagcctgtaatcccagcacttttgggaggcggaagcgggcggatcatgaggtcaggagatcgataccatcctggctaacacggtgaaaccccgtctctactaaaaataccaaaaaaaaaaaaaaaaaaaaaattagccgggcgaggtggtgggtacctgtagtcccagctactctactcgggaggctgaggcaggaaaatggcgtgaacccgggaggcggagcttgcagtgagccgagatcgcgctactgcactccaccctgggcgacagagcgagactgcgtctcaaaaaaaaaaaaaaaaagtaagactagttaaagtaaaaacttcatcattgtattataggatatataaaatatatgtaatacagaatgacactaaaacttaaaggacgggagtaggaaaaacatctattagttgcaaatttcttatattttaagtaaacttctacaatacagtaagtagacaaatagttttaaatgtatcattctttattttccagaatagccctgaaaatattaaagaggtatagcaaaaagccaataaataaaaatcaaaacagaatccaaaaatattattcaaatatttaaatagagtctattctaggagccagtttggtctaacattaaaaaaatcaatcaatgtaactcatcttattaacacattttaaaaaatctatttgattatacctacagatagaaaaaatttggtaaaatcccaaactcatttatgataaaaacactcagaaaattaggttgaaaaaagggacttcttcaatctaataaaggcacctgaaagaaaccaacagcttatgtcacacttaatgagagaaatattaaacgtcttcccatttttatttcttaaatactaaacatgttcaagatcataaagaagtcaataatgttcactcttaaccacttctattccatattgtactgatgcataaagacaagaaaaatactaaaaagctgaagatcaaaggataaggaaaacctttttcagagatgaaaggactacttacatccaaatatttaaaaaactatacattaactactcaaattaataagtgcataccttaatttattattacaacatataaaaattatattttgtatactaatggtaaacaattggataattcaattttaaaacctaaatttatattaaaaacaaaatatttaaatttagcaaaaggcatgcaagacttgtatacagaaaaataaaaatagttgctaaaggaaatgaaagacagttttaaaatatagaagtataaatcatgtccatggattgttgcagcctctgcctcaggagtcccctgcagcctggaacacctaacaaaagaaatgcaggtgcagtgccagggattggaggtgattccccacaagtcctaggagcaaaccttgtgagggggccatctctctcccccacccacctcagagcatgcctgtgaacaagaaagtacaagagccacacaagctgggtgttagcctagctatcggccattactcttaagcgccatctactggatcacggcacaaactaccacactaaaattatcatgctaattatatatgcaagatgtgaaaccaggtgcaagaattcacccacatatgcggattctgtacagagccctggccctctgaaagcatccagaaatgaatccaactgaccatactcaacttaccccgcagttaaaggaacaccaaccctatcagatgagaaagaatcagcacaagaactctggcaattcaaaaaaccacagcatccccttacatccaaatggatcactagctccctagaaatggttcttaaccagtctgaaatagctgaaatgacaaacacaaaattcagaatctggatagaaaggaagctcattgagattcagaagaaatttgaaactcaatccaaggaatccaagtaacccggtaaaatgatccaagaactgaaagatgaaatagccattttgagaatcagaataaacttctagagctcaaaaatttactactagaatttaataatgcaattctgctgtaaattctgctgtaaattattaattaacagcagaacagaccaagctgaggaaagaatctcagagcttgaagatcagttctttgaatcaacttagatgaaaattaagacaaaagaatttaaaaaatgaacaaaactggctgggcgcggtggctcacgcctgtaatcccagcagtctgggaggccgaggccggcagatcacgagttcaggagatcgagaccatcctggctaacatggtgaaaccccgtctctactaaaaatataaaaaaactagccgggcatggtggcaggtacctataatcccagctactcgggaggctgaggcaggagaatggcgtgaacctgggaggtggagcttgcggtgagccgagatagcgccactgcactccagcctgggtgacagagcgagactctgtctaaaaaaaaaaaaaaaaaaaaaaaaaaaaacctctaacaaatataggattatgtaaagatataaaatctatgactcattggcattcctgaaataggaggagaaagagtaagcaatttcaaaaatgtatttgaaaaacaccaaaaaaattgcctaatcttgccagagaggttgaaattcaattccaagaaatacagagaaccctggctagttactatataagacaactatccccaagacacatagtcgtcagattcaccaaggtcaaggtaaaagaaaaaaaaattctaaaggcagctagagtgaagggtcaagtcacatacagaggaaaccccatcaggctagccacagacttctcagcagaaaacttatacgccagaagagattgggagactattttcagcatcctgaaaaaaatttaactaaaaatgttatatcctgtcaaattaaacttcataaatgaaggagaaataaaatcctttttagacaagcaaatgctgaggaaatttattttaagtagaccatccttacaaaaggtccttaagggagtgctaaatatggaatctagagaacctgctgccataaaacacttgagcacatagcccacaggcactataaatcaactatgctgtcaagtctacataacaaccagctaacaacatgggtatgaaatcaaaatcacacctatcaatactaatcttgaatataaatgggctaaacacctgcttaaaagacattgagtggcaaactggataaaaacacaagacccaaccatcactgccttcaagagacccatctcacatgtaacaacacccacaggctcaaaacaaagagaggggaaaatatctatcaagcaaatgaaaaacaaaaaaggacaggagttgctattcttctatcagataaaacagatgttaaacaatgaagggcattactataatgataaagagtacaatccaacaaggagacctaacaatcctaaatatatatgcatccaacattggagcacccatatccataaaacaagttcttcttggcctatgaaaagatttagacaaccagacgataatagtgggaaatttcaacactccactgacagtgttagacagatcattgaggcagaaaactaacaaagaaatgctggacttaaactcagcacttaaccagttgaaactaatagacaaatacagaacactccacccaaaaggaatgcttatacattgttggtggaaatgtaaattagttcaggcactgaggaaagcagtttggagatttctcaaataatttaaaacagagctaccattccacctagcaatcccattattgattatatatccaaaggaaactagatcattataccaaaatgcactcatatgttcatcaccatgcaattcacaatagcaaagacatggaatcaagcgaggtgcccatcaatgatggattggatgaagaaaacatatatgctatggaatactacacagccctaaaaaaagaatgaaatcaagttgtttgcagcaacataaatagagctgaaggccatagtcctaagtaaattaatgcaggaacagaaaaccaaatactacatgttctcacttacaagtgggaactaaacattgagcacacatgaacataaacatgggaatgattgacactgagcactacttgaggggaagagagagggaggttgacatgggttgaaaaactacctattgggtactatgtttgctacctgggtgcagtatacccatgtaacaaaccttcatatgtaccctctgtatataaaataaaagtgggaattttaaaaagactaaatatgttaaaactagcactctctaaattttatctacagtaattaaaatctcaattgttatctcaactgtttttgttttctaagaaactaaaaagctgattctagaaggtatatgaacacacaaagaatttatgagaagtcccactcctggttagaagcctatgtatgtttcaggccagaggtaattaattacaaaggctttacctggcaggcttacagggtgtggagaggctgttctgcccaccccagacttggttcacagccaatgcattgcagtctttgaagggagttgcagtcaaggaccccctggctggtcacgcccttgtgcatatttatattgccagctcaggatcctccattcttaggtctctttatctgaggcctatgtagaggtcttcttcaggtgcctctgtcatggcctcctaataggagaggaagagaaagccttaaagacacttttctccactctgagtacccagtgagtttccactttctccttgcagggccccccaacagtgagacaaacccatgtctgcactaatccaactaacccttgaccagtgccatttccacagggaaaaatggaacagggggagtcagtaatttctctggctttagactcttgcttacactattaaaggaggtaattaaagacttaactctttccttttgggcttgttgctttaattggctcactacctgggtgcaatatacccatgtaacaaacctgcatatgtaccccctgtatctaaaataaaagttgaaattttaaaaagactaaatatgttaaaatgagtacctaagtcctcagcactctttttcagttctgctgagctcctgacactctagaataatcaaaacgttatttagaaagaacacacttggagtactttcactatctgacttcaagacttactataaacccacaataatcaaaggaatgtggtactggcaaaaggacagacaaatagaaaatacacattaaaaccacaatgagataccactaaccatccacatacccactcaaattaaaccacctggcaacaccaaatgctggcaaaaatttggagtcccagaacttacatatattgttggtgaaagtggataatacaaccaatttgggaaaataatagtttcttataaaactaaacccctatgatcatctaccccatgagccagcaattatactcctaagtatttacttaagagaaataagagcatacatctacaaaaaaagacttaaagcagaatgtttacagaaagtgatttcatcattgcgaaaacctggagacatcttgaacgtccatctacaggaagtggctaaacaaagggtagtatatccacatggtgacatattccactgccacaaaagggaatgaagtactaatacacacaacttgaacaaatcttaaaaacgttattctgagtgaaagaaactttgcatagaagagtgtatgatgttattccatttatagaaaattctagaaaagaataatttataatgaaatcagaactctggttgcctctaaggggttagcagtgaggaaaactaaaggtatgagaaaacttggagataatggtaatattctataatttagtaggttacacagtgtatgcatttgtcaaaacttgtttaacagtattcaagatttgtgcatggtgctgcatgcaaattttacctgaaaaacagcttcaactccagttaattatatgtgtgctgaactgcttagaagtgaagtatgctttcagttgacttttcaatgaattaaaaaactagatggattgatggatgaatagaaggatggatagatggattgttatgtggtaaagcagtaatagttttatccagaatctaggtggtgggtacatgcatgttcactgtataaaactttcagcttctatagatgtttgaaaattctcataataaaatggaaaataatggcacaattctatgtattttttaatcaactttgaaatatgccgataagaaccacattgctaattaaagaagtgaagtacaggaaggtttgggctgtgtgtttctgtgtaaaagaaggaggagtcaaaagttagccaggcgtggtggtgcacgcctgtagtcccagctacttgggaggctgaggcaggagaatggcgtgaatccaggaggcggagcttgcagtgagccgggatcgcaccactgcactccagcctgagcgacagagctagacttaatctcaaaaaaaaaaaaaaaaaagaaggaggaggagtcagatttacataaacttgaacaagcaagaactattatttctagaacatgtaccaaaacacttacaagactgtctctggagagggaacttattttttgttctctgttataattgaatcattaaccatgtgcatgtattaattcaataaataaacacattaaaattaaatgagagtttagtatccataacattccctgagagaaaaatctagagactactgcagtttgaaaggcatgtaaagagaggggaatatgtttgcagttttgttttttgttttttgtttttttcaaacaaagagaatactgatgaagaggcaaagatttggaatttagtaaagaatagggatcatttgttaattttcagaagcttttaggataaatgaaatgaaaaagatgctgggttattttggcagggagtttgatacatttgactaaaagatttaaaaatatacctacatgtcaagaaaaactgaaatattctatacgttttactacttccacttagcagagtttatcttgagccactgtccgtggcatgtccaatagatgtaaaggcttcacacacactcctcatatgaacaagttactgaaatattgtcaaagtgtcacattttctctattataaggtaaattgtttttcacaattctattttctttgaaatatgggtaagtcctataatcaatcttcacctttaatgtggtagtactaaacactacccagagtaacaactaggtatttaatagaacatcgtataatagagagaatctcagaatcaaataagataggtgagtttttgcaagcctgtctttctagagttccctagtattctttagagtgttaggcctatcattctcagctacccaccagattgtactttactaaggcacaggcaactgtaagagtcagacaatacttgatagtgttgatattaacacttgagatttgtgatcacataggcattgatttgagtcctgactctatcacttactcctggattatatgaacttggatagattatttaaggtctctaggtcttatctgtaaaatttcctaatctgtaaaaatagtgtgacaataataaatagcctaaccaaaaaatagacttaaataaatgtatgaaaagcagagtaagtgctcaaaaacttagctctactcttatgcaaaaatgaactattttaagcagttacatgatacaagaaatcagcttgataatggaaaaagatcatagcattgtggtcaatttttttttttttttttttttttttttttttttttgagacggagtctcgctctgtcgcccaggctggagtgcagtggcgcaatcttggctcactgcaagctccgcctcccgggttcaccccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccattgtggtcaagttttacacaggcatgatttgtttcgtggcctagactgagttgaattagaatagaagaaaccatattacaagtattcaggaattaagcaaagacaaaaaaatagttatgactgtgataactgaaacaaaggaaaacatataagagacaatgcatttaatttgcaaattgacaaataaggtaggtgaggaaaaaaagaggcttatggaattcttgagcctaacgtgcaagaagaacaaggatgccgtttgttgggagaggggaattgaggaataagagcccatttattggtgtgtgtatgtgttgggggaggaatgagttcagtttgggacaaccatgaagacccagcagacagttgaaatactgttatggagttcccttatattctaacctattacctttagttctttgaagtcagttctgcaccccactttttgctctacacccagacagtagcacagactggtgttcagtaatggcagatggaaaagtaatgggagaacggtggtaagtggccggtgcatgctgcaaggcttgtgcatgaagactcatcctgagtgaagagccacacagttccaccagggggaagactggtttttgcatatcctgcagaaactcaaccacctattagaggagagaaacagagcgggaaagaactacgctgtaggaaggaaagatgaacttgagtttcacttcttagtgccttttctcaggggagaggccatcacttgaagatgctgtctcctgctccttctccggggattaggtatgagccttgacttgtgaggagtctggggttaatgttaatgctgggtagagaggtggaaagacttcctctccggagagtctgaagccaccagacagaagatgaaggggatatgttagattaaaggaccataacagagtaattgtcggcacaataaaaaggaggcagtgccctggggtcctttgggagctgaggtggtattggagagataaagcagagactttcccgtctgaccccaagcttgtcggccctcatgaatatctctctggaactaggctctgtgttcagtgctgtcatctctcaaaagccaagcagggatatctgtcaacgtggaacctccatgatgatccagtgtcaagtcgacagccaagtcaccatgatgttctggtactgtcagcaacctggacagagcgtgacactgattgcaactgcaaatcagggctctgaggccacatatgagagcagatttgtcattgacaagtttcccatcagccgcccaaacctaacattctcaactctgactgtgagcaacaggagacctgaagacagcagcatatacctctgcagcgttgaagacacagtgcagggcacagatcaaagatctaagcaagaacctcagctcccttctacccagctcccctcacatgaacctgagggccctgtcaaggtgggacagaagaggaaaccacagctcttgggtagacacagctgcttctgtgcttgtaggtgggcatgggtatgaatggatagactggggatgaggagagcatctgcaggactagctgcagtgttctatccacagtcaggaagagtggctcctggaaagctgagggtaaaatttcttctagaagggtgctcagaaatacccaataaaaacaatcagatacagtttccttcaagtggcagggtcagtaatagcctttaactgttttatctcaaggctctatttagctggttttctatcataatatattttggaagaactttagtcatcttgaaacaaagctggtattacattaatgacatctggttgttctccgtggataggaattataaagccctctagatgcctcagtatgacaatatgacacatgcatcccagaccaatataaaatctgcaaagttcaggaaccttctatactggtgagttttggagtggtccagaggtttggggcatgttgaaatatctcctctaatgtgagaagtaagctgctgcaccttagatcatctaccacagagaaagagatgcaatgcttagtctttggactttgaattaaactttggatatactgcatttgattgtgctactctattccgtttactatgtaatctgtaaagctggggccagggaaagagagggttctgtggcagaacaagcccatgataaaagcttcctgctgcttgggccatagactaagcagacccagttgctcctgaagagcctatggtagatacagatgctctgtggagctcctgacattccccagtaagagaatcacaaggcagtgtggaacaggttcactgtgccctgatttgcacttcagaccactgcatcttgggctacacttttgttgctttccagaccccagagagaaagaatgctctcacacacaaattacacgaagagtgtttattacttacacacaggcagcaagggaaaacagaggcctaagattcagggaaagccagtcccactaggctcaggaaagctgtccagggtggatgaaatcttgtctgtgccttccctacttgcactgccactgggggacctcagagagcagccaccctgggttttatatcacagagcaacttgacatgcttggcaaagcactgaaggacattctatttctagaagggactggaacagagccctggctattctggacagttcctccttatctcaggatgttacattcccagaacattgtacagttattcttgagaactacaagcaagaaactggggagtactgagtttgtccaaggccacctggagaattgccctgcagacaggtgcagagttttggttaaagccatactcttaccagccaacgaccccctcttcttcttttgaaaagttgctcctggctctgtaatggatgccttataatggcattcagaacaaggtattatctgatctgcaaaactgaatttggttgtgcccagagcattctctctgttattaaatggaaaatatataatcaagaccatacttaagcacagctggaaaaaggcacaattcaatttcaagagcacatctgagtctcacggtaccctactcatacttttctcctcttaccttcaaaccacacctaagttttatggaaattccatatttccagttgagaaacatgagctcattgttttagatgggtcttcacgttattctggaaggatcattacagtctaaccaagtatggttctgaaaggtagtggtgaagggaaatcctctcggggccaaaacttaaattggtatacctgattgttgtccatattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcagctgactttgttcatctaaattatattaatttttatttctagaaaatccacttgggtcatttacaaatatgagtggccatttttgaaagcatcttactccttgtgtattttaaaactattttctttttataagtatattaagcatctactgggaattcttatctgacaatgccagcatttgatacctttttgcatctggtttttagtagtctgctggctctcactcagggtggcctatttccttgggcattatttaatttgatgtcaattcatctttcagaattctttaaatactggagtaaaagtgggttttctaagaaatattcatgcttgcctctgtcaagaaattggggcgctacagacctaatatcactttttttataattctcagtagatatcttcttggtcacagaatgtctatctcaaaccccaatgggctgactgttcagcgaccatgaatattcagaggaattttttttaaatccttcacccaaagccaagaccaagataaataatattctttgttaactgtttctaggattagttttctagctcatcctttcactaactgtgtatctctttgtgtacctcactttatgaaggagtgattcctatctagtttctggtccatgtaaggtgtcatgggccttctccagtttccacgtgtactaattctccaggtcacaggaatgcacatgtatacccattttatgtcatgggttcagtgctagcttaccttcctgctcgatgctcccattaccataggaagttgacaaatttacctacagtgaagccttggattatgaagcaccttcctatattacaaaattgcctctttaaaagcagtaaagcactgtgcttaggaacttgaactttatcaagtgacagacctaagtttaaaacttggttcttctttaacactaggtgtaaccttaacaagttacacaatttctccatgccttaatttctccatagaaaataagaataatagtgagtttttaaatgtagggtttttttataagaaagtgatgcaattatctgcataaaaagcacacagagacaaaatatgcaattagtgtagttgctacctaaacgtatttctcactataaaaacatattttaccactagcaattccttcctcaagaataagtatgacccgctctcagaaaattttattattataattgtttctcttttagctattttaattacataaaaaatttgtggtattataaaatatgcatattatcaaaataaaaagtcaaaatcgttcagtttaatacaattagatcatacaatatgtagttttagaatttattcccttaacccaacaatatttcatgaatatcatttcatgtcaaaaatattttacattaactttaataagaatagttcaatacactgatgaccatccttcatacaatcaaaacccatgacaaggtatatatccataggctagatgacagggttatttaattttaaatagcaattggttgtgtgttttgaattatttctgttacagactcagaagtaaaccatgaaagccctcctaactctacctgcagatggctggtcctttttattcaggtgttaacttaaatgccacctccccaaagagacccttccactctacgtaaaagcacttcagcagtcatcccatattatattatcactttatcctattttactaatatatactcatcatttactgaaagcgatgtatgtgcatcccatttctatacctcctcacatgtgcataaatgcatgcacgtgtactcacaaatgcactgaaacaagaaccttttctatcttcttcattgctgcttccaaatagcctagaagaactcctggaatatcactccaggaattcaataaatatttgtgagtaaataaatatgatttcaaagaaaagaggaaaatttatacagctgcagtggatttccctggaggaaaactctacaaaggcatttgagtttagataatctaagcccataagaaaattaactagattattctaacaggaaaggaataagcacttcaaactttatattttttattcttgtttcaaatttatgttttagttgcggggaggataggaaaagattaaaggacacaaaattacagctagataggaggaataacttccagtgttttacagaactgtaggaagactacagataacaagctttgtatttgaatagaaaggtacacatgtcatgtgccaatccccttctgctgccttacccaagactgggaaatggaacagatgatatgggttctacagagaagcaaagtgcagaacctgctcaaacacagtggctctggggtggaaggttctcaattggaattgtgctggtgcctgtgtggatggagcactcagttctgagccttgggagccttttgaaggccctcctggccaagacgatcttgaggaaatgactgacccgttggctgccttccaaatggatgacacagtctagacttttataagctaaatgagtagaaggaacccagttgactggatttatcaccaaacccagcttgtgagcctcaatttagagctagtataatttagaaaaataaatacatacaccatatattaaactctgagtatcatgaaacagatcctagatgttacaatcataagaatctatatgggtgtttctcctgcactctgtcctggctttcttctgcttcctgtctaagggagcctggactcacttaagcagctctaataggccaaacaagagagtggtcaaggagtggctgaaatgtgaacagaaagactcaccattatattacagcaatcaatctatccttaaaataatttaggtttagtctcaagtgctagaggcttccccatttacccatacatggaagcctgaagaataaacagaactataaacttccctccgggcataaaacttgcatgtcttccatggcttcaaggtggggagcagctgggcaggcagaaggaggggcaaggggcaggcaagaggaggggcaggaggcaggcagggaggaatgggctactccatttagctgatcagccttgaccagttcatgctctgcgactccatattacaagtcagacttttctggatcatacagagcactcccttcactctccagattcagtgattcctgggatgagatagtaacaaaaacaattccttattggataaagcgaaattgtgccgtgggggagataagaagcttagaaaaaaagaaaaataatggatgaggagaggagctgggagtttggcgggaagacagcctaaaatctgacaatctgtttgcagaatgataaaggatgctggaacccaaggaggagttgactaagagcttaggagaaagatctggtgggatttggagaagaaagtgttaaaaaaaaaagaatttggaatctgacacttttcagactactatgaggtctgaaagactcatgtagcaacgtgaagaggaacaaactttgtctgaatagggaaggttctagtatgatctttgctggagaagtcatttgaactctgagttttagattgttgatttgtaaaaaggagagaacaatatctgctgcctaccacctcagtgagggtgcaccaaggatcagctcagaggaggcaaagcagaatgccctatggcagagcatggaggccctagagtcagaccaccatacttacatcccatctttaaaacctactggctgtgtggccttgagcaagtcactttacctccagaaagctcatttaatcacctggaaaatgggcaatcgcataagtggttgtaatgtaaaatgaagaaaaaattcttaacttatatgagttacatgctgtatagtaacatggtatatagtaagcacacagaattgattcactgttatcaaaattgaaggacagtggtttgatgtgctaagcactcagtacaagccagaaagatgtcttagagaagaagacaaagaaatctctagttcaggatgaagagtaccaagaatggcatgtcctccaaattgagcttgggcagctggatctgaacctatcctacacatctgagtctacagtatgaggtaacagtctccacctatagctatcttctctgcctgtaaggtcattcctttttgaagaaagctgacctcagactatactgtgatcatttaaggaagagcgcaaaatactggagaaggctaatcttcaagctctagatacagaaaatcctcatattcttgggtgttcctttcagacagagtcagagccacaagcactgatccaaaaatcccgttctccaaaaaaagtttccatcttctgccaaggttcacctccctatttagtgcacactggtgtctacagttgctacagcaagagcctttccttatcctctaaggcaggagttgtgtgaagaccccatgacaaggggacaaaatgaaacaacatgtttaggggcaacacaggaaaaacccatattatcaatgctccaaaacctggatacctcaggcttggccagtcatttgtgagcagagaggtgtgtcatctacatggcagtcatggcctggatgggtctggaactgtggcaagggaagtctctgagacaaggtgccaggagaaagatgaattcaatcatctatttctgccaggaagaaaagcaggaggaaggaatcagatgcacagtttgtcctctggggacctctgccttgatcctcaataaatctccttttagatgtcacctgcagcaattcccacagttcacaatgatctccatggcttccgttggccttatggtgagctctgccaagatctgtattcttgggcaagacagaatccttctgaatctcagtctcttcctctataaatggaaataattttgctctgcacaaatcacaattagcatgtttgtgggaagtcaaactgtgaaactcagcataactgaaaagcaatgtaccactgttgcttatgtgaaaactcttgtaaagctgtcaggcaccatgcaccatctaagtacagcagtgttaggtatgagcccatcagtgattagaggggatgtggggtggagagcgggtctctgagcagtggatctcctggctttggggaagctggctcgttggccatgccaggagctgaacctgaaggtactctgtgtgtcctctcaactccacgggccccacattcgcattttttccaattccctctggtttccatttgcttcctccctctagccccctggccatgtccgatctcaacacgaagtttctgagcttttctcattttgttcaccatctccagaacatctctgcttcttttacttttcaaagaatttaaacttgaactctgctcactcctgcccatcaccaacctgagctcagagttgctgagaagggaaagcaccctcataaggaagctcctcctttccttacatcattagacttgatcacagacagcatctccatctccacactactctggccaggttgtgcctcagtcaattacacaactgtgtcttagtagccttggtagggcccaaatcaggatattctctgggaagattcacttgatactaagcccagcataatctcactgcatctaaaatagaaaattctagacccacccctccacatcttcttattgatcccaatatgtgacccatttaccatgtgctaaaatctctacctactgctgattctcagatcagatggtaacccagatttaccatggtccaaactctgacatctgatcaggggcatgtcattctggttcaggctgtcagccctgagcaggtgagtcagtttgcatcaccctaagtgcaggttgccaggacaaccgtgaggctgcataaaaagaacctatgacaggatgcacatgagagagacaagtggcttcacattgaagaaggggaggagtgcgccattggttttccatcctccagatgcactgagtaagctcctacctaacctgtgtcccctccttctttgaaacacttcccatccttttaagccttggtaggaaggagagccatctggaagcccagaatcctatggaatgctaagtctcccttctccttaccccttagtgttggaattctggatacccaaagtcttggatttgacctttgtgcacagtgactgcaaagaagcatattcatattcacaaaaatgagccttagataagactttcctcctctcgtgggggctccaggaaactgaaaagccaagcttgttaccaatgcttgcccttccttaagtacattattaaatacatccccaatagttaaaaggactcctagacacccaggccattctccctccttctaaccctcatctcctcggcctacgaaagcccagctgtgtgatccggggattggtttcccctgtcttccccatcccagcatccttccaggaaatagccagtctccctctctgctctcagaaggcaagtttccttatcacctgtgaatcacaaacccacagagtggccaaacgtagccgagctgatgcaagaccctggcaaggggaaagctgcaggtgtgtttgtgctgggaagaactgtgaccctcacctcacagacacctcctctcctgattcttggaagggtataaggacaggccttccaccaccagtcaggcacactctaccaccatgaatccattcctgatccttgcctttgtgggagctgctggcgagtttcatgacctgcctcaggccccacccaccccctttcctggcagacacatgccctgccattcttgccacctctcctcttttgactgcgctctgatattctatttcctccatctgacatatctccttcccatcctccttgggctctctttaagcctcacctgtttcaccttttccctcatttcactcccaccactgtcattcatccatatccgagctgtggttggagaagctgggaagggagaccaggtggggctggcccatgaaatgaagtggcaggcttcaggcttggctccaagagcaccagtatagcaccactatagctgctcttaacctcgaatgcacctggggaggttcaaaaattactcatgccagagattcaactctagaagttctaacttcatttgtctggggtgcagcctgtgtactgggcttttaagcttcccaggtgatttttaacgtttccaggcatgccgccaaagttaagaattgctcttctattggccaataacaaagtctacctttgttatgccaaagtgagcctggggctgccctcaactctgccctcactgcacagatctgagctatgggggaagctagtcatggccaggtctacccagacagggggttttcctagcttagccaaagtatcctgacaatccagggctcaaatagccagggcaagtacacaggtgatgaataaaagagagaagcactcagtgggtgagacaacaacataccaactgctaccccactggaagcattttgaggacattccttgcatcctcagcctggtgtccccaggagagatctgagcccctgcagggtacctagctacgtgccctgcagacacagagacttgggagccacatccagtgatgctcaccaggggtggcagcgctccctcccttgcctggcctcactgggcttgttaaggatttctaattggcaggaagcaaccgcaggctgggagcaccacccctaacatgctactgacttgccttctcccttcctatttccactccagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacgtaagtgtggggcccctgactgcaaagctcccagccaggctgcctgggagagcttggcttcagcccagggaagtactgaggttgggtaagacggatgggagaggtggtggaaaagaaaacttgttgacagcagctgactctccagagcaaggccaatccatgaaacagcaagggttgtggtcataaaagcaggcagggataatcttggagttgtcagagctagtgacaaaagcaggcaagtaccttttgctggttagctacacattaaagcgacctaagacagagtttttgaaaatactgatgcctgtgtcctaccccagggcaattaactcaaacttctcaggaagacagtgtgaataccagtgagtatttaacactctacctctggtaactgtagagtgtatagacagagctgagaaccgctgcctacacgaagaactctcaaacctgagtatgcgtcaaaaccacctgcaggcttattaaagcacaaatcactgggtcccatccccaaggttctgatcagcgggtgggggtaaggaccaagaatttacatttctaacaagttcccaggagatgctaatgctatggctacccttggattagattacacagaagggtggtgctcactaggccaagaagggagggaggaacaggcgctgtgcgcagttagcaaagacctggggtgaagaatgctgggaaaactacgaggagctctttgtgcccacagtgctagtgactgtggagatttgtgggaaagaggctgggaaggcaggttgaggagcagcctctggtgggatccctttgactcttccccaccccactaccaccagcctctgaagcagaaaggtcctgggtctcacacctgcactgacccacatccctctcctgcccatgcaatatggccacacaccccaccccatgcctccagagctatccatgagcagtgagcttgaggaccctggggaaggtgggaggggtgcccaggctgtgggagaaggtcttcaccatgcctgccctgcccatcagccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtggtgagtgggaccctttgtccttctacttccccccatcctcacaatttccagaacgaagcatgcccctttatttgaatcctcttgcctcccggcttaagacacatttctagtgcccattacacacagtctctgcactgggcaccagagagatgcaaagtctcaaggacttggctcctaaaatcaagagataggacaaatggagaacttgctgtgatcacgtcttgggaggggttcaacaatgatcattctggaaactaaaagccagagtcccttgccagaacttacgttttggagtcctctccagaggcagtgttcctcttcaatgttccatcccagattattgtctccttctctggcctcacccacatttctactttctttgatctcttcctgatcctcacagctgactacccagacgagctgaagtgcctggatgctccggtgctgacccaggctgagtgtaaagcctcctaccctggaaagattaccaacagcatgttctgtgtgggcttccttgagggaggcaaggattcctgccaggtgatttgaccctttcccatgctgaggctcccaccgatacccaggccccaccggggaaaaagatttgaactcccaaggtggcagggctgaggcggctccctgcagtgctcccatggagaaatgaggaaggtggcggggctgaggcggctccctgcattgcccccatggagaaacgaggaaggtggcggggctgaggaggctccctgcagtgcccccattgggaaatgagggaggctcccttgtgctgcacgctgcctgcttaggaagaacagagaatgggccaccgtgggaaggacgtggagccacagagctggctggaaaggggtcttttaaggttcacagtaaatgtagctatattcctcctccatctctctctttatacaacttgtcccttcttctccccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctcactctgtgtctgtgccggctccctcacactccttcacactggaaagcatcctccaatctcaggtcagacagggctgtccccctgaagggtaagcagagccgccagctcccaaaatgtgttccatggtacactagagtagcatatacaaagagatggaatccaaaaataatacgaagcttaggacaaaaggggcactgttttctagagaaaagtgtttcagaaaggtggtctttgggtgggtggtattgatttttctttgggcttctcacagtggttagagctactctgccttcgaacaatcacagcacagaaaatgtgtcagcatcttcgaggtggcccaaaaaatctgacgagctgaatcttattgctaaaatacaacaatcatgacaaatgctgttggtgatgacatgcctctcccaagaatgtgtcagcaccaagccctcccttctcattcacctggaaaatcagactcaagtaaatctccctggccccctaactcttccctcaattccctagttccatctctgtgagcaggctagagagatgttccacctaccatagcgggagcccgactgcgacttgggaatcaagcccagcactgcacgctgcattttcatcttctttgcctttgtggtaggacgctgcagtgaatcccacagctaacaccagctccccactctgacctgggatagaaattagagagggtcaagattcacccatttgatcaattaactgaggaaggattcattttcataaaacttgctcacctttgagacacttcaagtgagttatttgggactcttttaaaaacgtggaaggaaagacatctgagggctgtgacaccatccagccactctggccacacgttggctggcttgcatccactgcacgcagcagaggagggcaggccccgtgacacctgtgacacctgccaaagcctcctcctggcaattctgagagggcccatgttagggatgtagctcatccaagcttgtcactgaagatccaagcaagcttctctttgaaattccacctttaccttctgtcccaagtggttgtggacacccatgggagctggtaccaagggccaggagcagccaagggagacagacaagttcagagcacatttccagttacagggaacagagcacaggcctccaagtgtccatggagcagcatgcaaattgcagtgaggagtagaggaaaacctctacatggagcacagcattcctggcaaacacaggggaccgcagtccacatgctgtggaatatacccaagtatgcatcagacacttgtttggtgaacagtaaatgtgtaagatcaattaccttgagagggccatctgtgctccacatgtgtggttcgtgtgaggagatggctaccactcactatcttccgagggaaacagggctcagggcttgcacacgatggacagatacacacgggtcacccagaatgtcactgcatacaaacatcactttgttcaacatggattttgttttcatggagtccaaacgcagaccctagttcaccttacggccttgggtttgtctgcttttggagctatatatccagtagatagatagacagacaagacagatacattttctccctttcttaccataatgtcaatgcctcgtctgaatctcatcatcactcaagagtcaagagaggaaccaaatgcttcatataaacagggctgggcggggagcgttagttttcactgttttctgtctccattcagatcattcctatcaaagcccagctggttatctgaagccaagagacagaca

SEQ ID NO: 84 - DNA, 713 bp, Homo sapiens
gtggcccgggaggcgccgaggccaggtaggtgcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggccccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagggaaaaaaaaaaaaaaaaaaaa

SEQ ID NO: 85 - DNA, 2805 bp, Homo sapiens
gccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 86 - DNA, 3404 bp, Homo sapiens
gcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaa

SEQ ID NO: 87 - DNA, 3963 bp, Homo sapiens
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggtcggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctgaaaaaaaaaaaaaaaaaaaa

SEQ ID NO: 88 - DNA, 12709 bp, Homo sapiens
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccccaggtggctgttcctttgatgagcactacagcaactgtggttatagtgtggctctagggaccaatgggttcacctgggagcagattaacacaacggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccaggggctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaactcgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaactgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacattctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttgacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctgagattcatgttttcctaagataaaaaaaa

SEQ ID NO: 89 - DNA, 1796 bp, Homo sapiens
atggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcagactggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaaggtgagttagttactttctccaattctccctccttttaagttccctaaagcaagaagaagtgtccttctctgtagctacttctcaagctgatttggatgtgatattttttcaaaaaagacttatttctctatcaatccagttttcaaaacataagtgtaagcatttaagatttgcatgggctggccgggcacagtggctcacgcctgtaatcccagcactttgggaggctgaggcaagcggatcatttgaggtcaggagttcgagaccagcctggccaacatggtgaaaccccgtctctacttaaaatacaaatattagctgggcatgatgatgggcccctgtaatcccagctacttgggaggctgaggcaggacaatcgcttgaacctgggaggcagaggttgcagtgagctgagattgtaccatgcactccagcctgggtaacagagcg

SEQ ID NO: 90 - DNA, 1271 bp, Homo sapiens
tgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatatgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgttagtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaaaaaaaaaaaaaaa

SEQ ID NO: 91 - DNA, 2653 bp, Homo sapiens; identical to SEQ ID NO: 81

SEQ ID NO: 92 - DNA, 3817 bp, Homo sapiens
atggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtwgtttctcaaaagactttctgaagaccatctgctacacccccacctcctcttccatgagctccaacctgacccggagctccagcagcgatagcatccacagtgtccgtgggaagcccgggctggtgaagcagcggacgcaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccaaaaaaaaaaaaaaaaaaaaaaaaaaaaaaaaaaaa

SEQ ID NO: 93 - DNA, 4104 bp, Homo sapiens
ctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcctctcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaaaaaaaaaaaaaaaaaaaaa

SEQ ID NO: 94 - DNA, 3649 bp, Homo sapiens
gcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaa

SEQ ID NO: 95 - DNA, 3717 bp, Homo sapiens
gaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccataaaaaaaaaaa

SEQ ID NO: 96 - DNA, 1896 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtagcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 97 - DNA, 3764 bp, Homo sapiens
gcagccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgtgcgcttctggaaggccggggtgggagctctccgggaagaggagggggcatgctggggtggttccctggcatgtgaggaccctcctctcccatcttggctgcaggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaaaaaaaaaaaaaaaaaaaa

SEQ ID NO: 98 - DNA, 2837 bp, Homo sapiens
ccgcggcgtccacactcgccgcgcgcgcggggccgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgcccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagtcagattactagacagatataaacagatcccctgctgaacagatatacagagttctcagaccccaccccaccctcaggtgggctggctggctgacagaccttctggccagacagactcctaaccaaccagatggacgccagacaggcagacatcagtccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcaaaaaaaaaaaaaaaaaaaaaaaaaaaaaaaaaaaaaaaaaaaa

SEQ ID NO: 99 - DNA, 4089 bp, Homo sapiens
ccttcgcccctcctccgccagtcactggaatcaattccgtggggaatcggctccgccgccgcgaaggacagcctttccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcaggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacagtggaatcctgccagcagaagctgaactgatgtacatcaatgaagttgaacgtttggatggatttggacaggaaatcttccctgtaaaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgagataatttatttttttcccctttggaataacttttgtgaattattataatgcagtttccctagtaatatagtacttttcatttg

SEQ ID NO: 100 - DNA, 1549 bp, Homo sapiens
tggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaaaaaaaaaaaaaaaaaaaaaaaaaa

SEQ ID NO: 101 - DNA, 2607 bp, Homo sapiens
cggagactctgggggagggagacggcagcggcatggcggccgggtgtaagacgcccgaccctcctcttccctgtcttcgccgccgccgctgctggagtcactgggaccctctagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacatttttgtgtaatttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactctagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagctttcttacccagcatagtgggagagtggagattaattaaaattgttaattaagagttaaaaaaaaaaaaaaaa

SEQ ID NO: 102 - protein, 565 aa, Homo sapiens
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLACGVLRFSGYGHIWSQNATNLVSSLLTLLKQLEPTAWLDSGTWGVPSLLLVFLSVGLVLVTTLVWHLLRTPAEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 103 - protein, 1636 aa, Homo sapiens
MEAVPRMPMIWLDLKEAGDFHFQPAVKKFVLKNYGENPEAYNEELKKLELLRQNAVRVPRDFEGCSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 104 - protein, 198 aa, Homo sapiens
MDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMIYENMTLVEAIQTVQAHRNICPNSGFLRQLQVLDNRLGRETGRF

SEQ ID NO: 105 - protein, 1198 aa, Homo sapiens
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 106 - protein, 167 aa, Homo sapiens
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 107 - protein, 1899 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 108 - protein, 754 aa, Homo sapiens
MAAGVLPQNEQPYSTLVNNSECVANMKGNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 109 - protein, 603 aa, Homo sapiens
MASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 110 - protein, 384 aa, Homo sapiens
MEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 111 - protein, 217 aa, Homo sapiens
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKVTHILNVAYGVENAFLSDFTYKSISILDLPETNILSYFPECFEFIEEAKRKDGVVLVHCNAGVSRAAAIVIGFLMNSEQTSFTSAFSLVKNARPSICPNSGFMEQLRTYQEGKESNKCDRIQENSS

SEQ ID NO: 112 - protein, 313 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 113 - protein, 2485 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 114 - protein, 367 aa, Homo sapiens
MVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 115 - protein, 198 aa, Homo sapiens
MSDRKDVAVYPCLFLCIGWVAAENSAGIGVFSDPFLFQTAESAPGKVVNLTVEAYNASAVKLIWYLPRQPNGKITSFKISVKHARSGIVVKDVSIRVEDILTGKLPECNENSESFLWSTASPSPTLGRVTPPSRTTHSSSTLTQNEISSVWKEPISFVVTHLRPYTTYLFEVSAATTEAGYIDSTIVRTPESGMVHFL

SEQ ID NO: 116 - protein, 246 aa, Homo sapiens
MTSGEVKTSLKNAYSSAKRLSPKMEEEGEEEDYCTPGAFELERLFWKGSPQYTHVNEVWPKLYIGDEATALDRYRLQKAGFTHVLNAAHGRWNVDTGPDYYRDMDIQYHGVEADDLPTFDLSVFFYPAAAFIDRALSDDHSRKRDVRVRNLCRKAGPLGLLVAEGKGKILVHCVMGRSRSATLVLAYLMIHKDMTLVDAIQQVAKNRCVLPNRGFLKQLRELDKQLVQQRRRSQRQDGEEEDGREL

SEQ ID NO: 117 - protein, 595 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 118 - protein, 594 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPSLQSEYVHY

SEQ ID NO: 119 - protein, 387 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 120 - protein, 498 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 121 - protein, 657 aa, Homo sapiens
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 122 - protein, 621 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAVFLAKAITVENASVSVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCPKEREELKLKEKTYSLWPFLLEDQKKYLNPLYSSESHRFTVLEPNTVSFNFKFWRNMYHQFDRTLHPRQSVFNIIMNMNEQNKQLEKDIKDLESKIKQRKNKQTDGILTKELLHSVHPESPNLKTSLCFKEQTLLPVNDALRTIEGSSPADNRYSEYAEEFSKSEPAVVSLEYGVARMTC

SEQ ID NO: 123 - protein, 314 aa, Homo sapiens
MGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 124 - protein, 1897 aa, Homo sapiens
MVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAHEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 125 - protein, 331 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 126 - protein, 1735 aa, Homo sapiens
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEEDEGKVVVRLSEEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 127 - protein, 415 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWRLFFQQNAL

SEQ ID NO: 128 - protein, 1216 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 129 - protein, 435 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 130 - protein, 1997 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFKIISLDEERTVVLQTDPLPPARFGVSKEKTTSTGLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLSPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKRDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 131 - protein, 1436 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHRPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAMRQRFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRRERGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 132 - protein, 482 aa, Homo sapiens
MPPSPLDDRVVVALSRPVRPQDLNLCLDSSYLGSANPGSNSHPPVIATTVVSLKAANLTYMPSSSGSARSLNCGCSSASCCTVATYDKDNQAQTQAIAAGTTTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 133 - protein, 538 aa, Homo sapiens
MGAGGFMCPTLNAQLSLSADDHSRVRLTQLEGEPHSDYINANLVPGYTRPQEFIASQGPLKKTLENFWRLVREQQVRIIIMPTISMENGRVLCEHYWLTDSTPDTHGHITIHLLAEEPEDEWTKREFQLQHAPSSLLAFMELLLRGCPCGVGMGRTGTFVALSRLLQQLEEEQMVDVFHAVYALRMHQPLMIQTLGLKNLPAGPPRSSLSSLMPFPLAEPAGSLLLFVGRAERTRTGSWGTLSAFSLSNPPTRSWPISVTDLPQACAKRAASANAGFLKEYEAIKDEAGFSAPPPGYEQDSPVSYDRSQGQFSPVEESPPDDMPEAWLFPGGPSGRDHTVLTGPAGPKELWELVWQHRAHVLVSLCPPNVMEKEFWPTEMQPVVTDMVTVHWVAESSTAGWFCTLLRVTHGESRKEREVQRLQFPYLEPGHELPATTLLPFLAAVGQCCSRGNNKKPGTLLSHSKCCWTMVSCSKGATQLGTFLAMEQLLQQAGSECTVDIFNVALQQSQACGLMTPTLKQYVYLYNCLNSALADGLP

SEQ ID NO: 134 - protein, 593 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 135 - protein, 1174 aa, Homo sapiens
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKYRGLTAPDAEMLYMQEVERMDGYGEESYPAKDSQGSDISIGACLEGIFVKHKNGRHPVVFRWHDIANMSHNKSFFALELANKEETIQFQTEDMETAKYIWRLCVARHKFYRLNQCNLQTQTVTVNPIRRRSSSRMSLPKPQPYVMPPPPQLHYNGHYTEPYASSQDNLFVPNQNGYYCHSQTSLDRAQIDFNGRIRNGSVYSAHSTNSLNNPQPYLQPSPMSSNPSITGSDVMRPDYLPSHRHSAVIPPSYRPTPDYETVMKQLNRGLVHAERQSHSLRNLNIGSSYAYSRPAALVYSQPEIREHAQLPSPAAAHCPFSLSYSFHSPSPYPYPAERRPVVGAVSVPELTNAQLQAQDYPSPNIMRTQVYRPPPPYPPPRPANSTPDLSRHLYISSSNPDLITRRVHHSVQTFQEDSLPVAHSLQEVSEPLTAARHAQLHKRNSIEVAGLSHGLEGLRLKERTLSASAAEVAPRAVSVGSQPSVFTERTQREGPEEAEGLRYGHKKSLSDATMLIHSSEEEEDEDFEEESGARAPPARAREPRPGLAQDPPGCPRVLLAGPLHILEPKAHVPDAEKRMMDSSPVRTTAEAQRPWRDGLLMPSMSESDLTTSGRYRARRDSLKKRPVSDLLSGKKNIVEGLPPLGGMKKTRVDAKKIGPLKLAALNGLSLSRVPLPDEGKEVATRATNDERCKILEQRLEQGMVFTEYERILKKRLVDGECSTARLPENAERNRFQDVLPYDDARVELVPTKENNTGYINASHIKVSVSGIEWDYIATQGPLQNTCQDFWQMVWEQGIAIIAMVTAEEEGGREKSFRYWPRLGSRHNTVTYGRFKITTRFRTDSGCYATTGLKMKHLLTGQERTVWHLQYTDWPEHGCPEDLKGFLSYLEEIQSVRRHTNSTSDPQSPNPPLLVHCSAGVGRTGVVILSEIMIACLEHNEVLDIPRVLDMLRQQRMMLVQTLCQYTFVYRVLIQFLKSSRLI

SEQ ID NO: 136 - protein, 173 aa, Homo sapiens
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRAPVLVALALIEGGMKYEDAVQFIRQKRRGAFNSKQLLYLEKYRPKMRLRFKDSNGHRNNCCIQ

SEQ ID NO: 137 - protein, 1445 aa, Homo sapiens
MRRLLEPCWWILFLKITSSVLHYVVCFPALTEGYVGALHENRHGSAVQIRRRKASGDPYWAYSGAYGPEHWVTSSVSCGSRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKARLSLVSTKENGNGPMTVDKNGAVLIADESDPAESMESLV

SEQ ID NO: 138 - protein, 861 aa, Homo sapiens
GCWQTMGTTASTAQQTVSAGTPFEGLQGSGTMDSRHSVSIHSFQSTSLHNSKAKSIIPNKVAPVVITYNCKEEFQIHDELLKAHYTLGRLSDNTPEHYLVQGRYFLVRDVTEKMDVLGTVGSCGAPNFRQVQGGLTVFGMGQPSLLGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEDFDQLLEALRAALSKDPGTGFVFSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 139 - protein, 1304 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 140 - protein, 384 aa, Homo sapiens
MKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACMTHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 141 - protein, 1948 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRRQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 142 - protein, 188 aa, Homo sapiens
MAAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNTVHMVSSPVGMIPDIYEKEVRLMIPL

SEQ ID NO: 143 - protein, 419 aa, Homo sapiens
MKNQLRGPPARAHMSTSGAAAAGGTRAGSEPGAGSGSGAGTGAGAATGAGAMPCKSAEWLQEELEARGGASLLLLDCRPHELFESSHIETAINLAIPGLMLRRLRKGNLPIRSIIPNHADKERFATRCKAATVLLYDEATAEWQPEPGAPASVLGLLLQKLRDDGCQAYYLQGGFNKFQTEYSEHCETNVDSSSSPSSSPPTSVLGLGGLRISSDCSDGESDRELPSSATESDGSPVPSSQPAFPVQILPYLYLGCAKDSTNLDVLGKYGIKYILNVTPNLPNAFEHGGEFTYKQIPISDHWSQNLSQFFPEAISFIDEARSKKCGVLVHCLAGISRSVTVTVAYLMQKMNLSLNDAYDFVKRKKSNISPNFNFMGQLLDFERTLGLSSPCDNHASSEQLYFSTPTNHNLFPLNTLEST

SEQ ID NO: 144 - protein, 198 aa, Homo sapiens
MSSRGHSTLPRTLMAPRMISEGDIGGIAQITSSLFLGRGSVASNRHLLQARGITCIVNATIEIPNFNWPQFEYVKVPLADMPHAPIGLYFDTVADKIHSVSRKHGATLVHCAAGVSRSATLCIAYLMKFHNVCLLEAYNWVKARRPVIRPNVGFWRQLIDYERQLFGKSTVKMVQTPYGIVPDVYEKESRHLMPYWGI

SEQ ID NO: 145 - protein, 1337 aa, Homo sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYDDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 146 - protein, 1440 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 147 - protein, 185 aa, Homo sapiens
MSGSFELSVQDLNDLLSDGSGCYSLPSQPCNEVTPRIYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 148 - protein, 625 aa, Homo sapiens
MAGDRLPRKVMDAKKLASLLRGGPGGPLVIDSRSFVEYNSWHVLSSVNICCSKLVKRRLQQGKVTIAELIQPAARSQVEATEPQDVVVYDQSTRDASVLAADSFLSILLSKLDGCFDSVAILTGGFATFSSCFPGLCEGKPAALLPMSLSQPCLPVPSVGLTRILPHLYLGSQKDVLNKDLMTQNGISYVLNASNSCPKPDFICESRFMRVPINDNYCEKLLPWLDKSIEFIDKAKLSSCQVIVHCLAGISRSATIAIAYIMKTMGMSSDDAYRFVKDRRPSISPNFNFLGQLLEYERTLKLLAALQGDPGTPSGTPEPPPSPAAGAPLPRLPPPTSESAATGNAAAREGGLSAGGEPPAPPTPPATSALQQGLRGLHLSSDRLQDTNRLKRSFSLDIKSAYAPSRRPDGPGPPDPGEAPKLCKLDSPSGAALGLSSPSPDSPDAAPEARPRPRRRPRPPAGSPARSPAHSLGLNFGDAARQTPRHGLSALSAPGLPGPGQPAGPGAWAPPLDSPGTPSPDGPWCFSPEGAQGAGGVLFAPFGRAGAPGPGGGSDLRRREAARAEPRDARTGWPEEPAPETQFKRRSCQMEFEEGMVEGRARGEELAALGKQASFSGSVEVIEVS

SEQ ID NO: 149 - protein, 132 aa, Homo sapiens
MTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 150 - protein, 1118 aa, Homo sapiens
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRKPESGGSDHQLHLPELGGPRWHRPTELDLLRTSALEMVAEQRLETQQTPESPVDGLGPGSLYTCSVWVEKDGVNSSSWRLVTSTTAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVGYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCICGSSNSQPRPQPRRKSRMRMSKTSSTRTWPPSRPTSWRSK

SEQ ID NO: 151 - protein, 665 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 152 - protein, 211 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 153 - protein, 157 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSGTRKIVSEGELDQLAQIRPLIFNFHEQTAIKDCLKILEEKNSSV

SEQ ID NO: 154 - protein, 190 aa, Homo sapiens
MTASASSFSSSQGVQQPSIYSFSQITRSLFLSNGVAANDKLLLSSNRITAIVNASVEVVNVFFEGIQYIKVPVTDARDSRLYDFFDPIADLIHTIDMRQGRTLLHCMAGVSRSASLCLAYLMKYHSMSLLDAHTWTKSRRPIIRPNNGFWEQLINYEFKLFNNNTVRMINSPVGNIPDIYEKDLRTMISM

SEQ ID NO: 155 - protein, 807 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIGMACMEYEMGKKKCERYWAEPVEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSPLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTSGKSFTRSKSLKILRNMKKSICNSCPPNKPAESVQSNNSSSFLNFGFANRFSKPKGPRNPPPTWNI

SEQ ID NO: 156 - protein, 642 aa, Homo sapiens
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 157 - protein, 381 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESLLGLLLKKLKDEGCRAFYLEGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 158 - protein, 185 aa, Homo sapiens; identical to SEQ ID NO: 147

SEQ ID NO: 159 - protein, 330 aa, Homo sapiens
MSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 160 - protein, 1210 aa, Homo sapiens
MMAGTSCWYPSCPLIGSRMTPEPKALPPVALVRDTEGQLCLPQQRQRGWQVVMATRKDTEEEQVVPSEEDEANVRAVQAHYLRSPSPSQYSMVSDAETESIFMEPIHLSSAIAAKQIINEELKPPGVRADAECPGMLESAEQLLVEDLYNRVREKMDDTSLYNTPCVLDLQRALVQDRQEAPWNEVDEVWPNVFIAEKSVAVNKGRLKRLGITHILNAAHGTGVYTGPEFYTGLEIQYLGVEVDDFPEVDISQHFRKASEFLDEALLTYRGKVLVSSEMGISRSAVLVVAYLMIFHNMAILEALMTVRKKRAIYPNEGFLKQLRELNEKLMEEREEDYGREGGSAEAEEGEGTGSMLGARVHALTVEEEDDSASHLSGSSLGKATQASKPLTLIDEEEEEKLYEQWKKGQGLLSDKVPQDGGGWRSASSGQGGEELEDEDVERIIQEWQSRNERYQAEGYRRWGREEEKEEESDAGSSVGRRRRTLSESSAWESVSSHDIWVLKQQLELNRPDHGRRRRADSMSSESTWDAWNERLLEIEKEASRRYHAKSKREEAADRSSEAGSRVREDDEDSVGSEASSFYNFCSRNKDKLTALERWKIKRIQFGFHKKDLGAGDSSGEPGAEEAVGEKNPSDVSLTAYQAWKLKHQKKVGSENKEEVVELSKGEDSALAKKRQRRLELLERSRQTLEESQSMASWEADSSTASGSIPLSAFWSADPSVSADGDTTSVLSTQSHRSHLSQAASNIAGCSTSNPTTPLPNLPVGPGDTISIASIQNWIANVVSETLAQKQNEMLLLSRSPSVASMKAVPAASCLGDDQVSMLSGHSSSSLGGCLLPQSQARPSSDMQSVLSCNTTLSSPAESCRSKVRGTSKPIFSLFADNVDLKELGRKEKEMQMELREKMSEYKMEKLASDNKRSSLFKKKKVKEDEDDGVGDGDEDTDSAIGSFRYSSRSNSQKPETDTCSSLAVCDHYASGSRVGKEMDSSINKWLSGLRTEEKPPFQSDWSGSSRGKYTRSSLLRETESKSSSYKFSKSQSEEQDTSSYHEANGNSVRSTSRFSSSSTREGREMHKFSRSTYNETSSSREESPEPYFFRRTPESSEREESPEPQRPNWARSRDWEDVEESSKSDFSEFGAKRKFTQSFMRSEEEGEKERTENREEGRFASGRRSQYRRSTDREEEEEMDDEAIIAAWRRRQEETRTKLQKRRED

SEQ ID NO: 161 - protein, 780 aa, Homo sapiens
MEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 162 - protein, 643 aa, Homo sapiens
METSSSCESLGSQPAAARPPSVDSLSSASTSHSENSVHTKSASVVSSDSISTSADNFSPDLRVLRESNKLAEMEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 163 - protein, 2314 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 164 - protein, 1452 aa, Homo sapiens
MRGLGTCLATLAGLLLTAAGETFSGGCLFDEPYSTCGYSQSEGDDFNWEQVNTLTKPTSDPWMPSGSLMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGPTVVHCLNGGGRSGTFCAISIVCEMLRHQRTVDVFHAVKTLRNNKPNMVDLLDQYKFCYEVALEYLNSG

SEQ ID NO: 165 - protein, 659 aa, Homo sapiens
MALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRSRKVVRQASVHDSGEEGEA

SEQ ID NO: 166 - protein, 802 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 167 - protein, 326 aa, Homo sapiens
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 168 - protein, 704 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKLNAMANRAAGKGYENEDNYANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 169 - protein, 593 aa, Homo sapiens [sequence omitted]

SEQ ID NO: 170 - protein, 150 aa, Homo sapiens
MGVQPPNFSWVLPGRLAGLALPRLPAHYQFLLDLGVRHLVSLTERGPPHSDSCPGLTLHRLRIPDFCPPAPDQIDRFVQIVDEANARGEAVGVHCALGFGRTGTMLACYLVKERGLAAGDAIAEIRRLRPGPIETYEQEKAVFQFYQRTK

SEQ ID NO: 171 - protein, 360 aa, Homo sapiens
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 172 - protein, 303 aa, Homo sapiens
MGRKVHSNGSQFAEHSRSPRRTGRDCKPVRAPSMALGVSQLAGRSRCLCSESQGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 173 - protein, 926 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPSQYRFVCEAILKVYEEGFVKPLTTSTNK

SEQ ID NO: 174 - protein, 1463 aa, Homo sapiens
MASLAALALSLLLRLQLPPLPGARAQSAPGGCSFDEHYSNCGYSVALGTNGFTWEQINTTEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGAPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQLAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 175 - protein, 449 aa, Homo sapiens
MALVTVQRSPTPSTTSSPCASEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWSALQSLHKACEVARAHNYYPGSLFLTWVSYYESHINSDQSSVNEWNAMQDVQSHRPDSPALFTDIPTERERTERLIKTKLREIMMQKDLENITSKEIRTELEMQMVCNLREFKEFIDNEMIVILGQMDSPTQIFEHVFLGSEWNASNLEDLQNRGVRYILNVTREIDNFFPGVFEYHNIRVYDEEATDLLAYWNDTYKFISKAKKHGSKCLVHCKMGVSRSASTVIAYAMKEYGWNLDRAYDYVKERRTVTKPNPSFMRQLEEYQGILLAR

SEQ ID NO: 176 - protein, 340 aa, Homo sapiens
MLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPFEKAYEKLQILKPEAKMNEGFEWQLKLYQAMGYEVDTSSAIYKQYRLQKVTEKYPELQNLPQELFAVDPTTVSQGLKDEVLYKCRKCRRSLFRSSSILDHREGSGPIAFAHKRMTPSSMLTTGRQAQCTSYFIEPVQWMESALLGVMDGQLLCPKCSAKLGSFNWYGEQCSCGRWITPAFQIHKNRVDEMKILPVLGSQTGKI

SEQ ID NO: 177 - protein, 704 aa, Homo sapiens; identical to SEQ ID NO: 168

SEQ ID NO: 178 - protein, 1049 aa, Homo sapiens
  VARIANT (1)...(1049): Xaa = Any Amino Acid
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEDDAIFGILNKVKPSYKSCADCMYPTASGAPEASRERCEDPNAPAICTQPAFLPHITSSPVAHLASRSRVPEKPASGPTEPPPFLPPAGSRRADTSGPGAGAALEPPASLLEPSRETPKVLPKSLLLKNSHCDKNPPSTEVVIKEESSPKKDMKPAKDLRLLFSNESEKPTTNSYLMQHQESIIQLQKAGLVRKHTKELERLKSVPADPAPPSRDGPASRLEASIPEESQDPAALHELGPLVMPSQAGSDEKSEAAPASLEGGSLKSPPPFFYRLDHTSXFSKDFLKTICYTPTSSSMSSNLTRSSSSDSIHSVRGKPGLVKQRTQEIETRLRLAGLTVSSPLKRSHSLAKLGSLTFSTEDLSSEADPSTVADSQDTTLSESSFLHEPQGTPRDPAATSKPSGKPAPENLKSPSWMSKS

SEQ ID NO: 179 - protein, 913 aa, Homo sapiens
MTSRLRALGGRINNIRTSELPKEKTRSEVICSIHFLDGVVQTFKVTKQDTGQVLLDMVHNHLGVTEKEYFGLQHDDDSVDSPRWLEASKAIRKQLKGGFPCTLHFRVRFFIPDPNTLQQEQTRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPLLVHCSAGIGRTGVLVTMETAMCLTERNLPIYPLDIVRKMRDQRAMMVQTSSQYKFVCEAILRVYEEGLVQMLDPS

SEQ ID NO: 180 - protein, 979 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 181 - protein, 524 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 182 - protein, 400 aa, Homo sapiens
MSTELFSSTREEGSSGSGPSFRSNQRKMLNLLLERDTSFTVCPDVPRTPVGKFLGDSANLSILSGSPGFFRTSGSAFSWDDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 183 - protein, 601 aa, Homo sapiens
MEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENVRFWKAGVGALREEEGACWGGSLACEDPPLPSWLQDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 184 - protein, 460 aa, Homo sapiens
MSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVILMACREIENGRKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 185 - protein, 1187 aa, Homo sapiens
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHSGILPAEAELMYINEVERLDGFGQEIFPVKDNHGNCVHLGIFFMGIFVRNRIGRQAVIYRWNDMGNITHNKSTILVELINKEETALFHTDDIENAKYISRLFATRHKFYKQNKICTEQSNSPPPIRRQPTWSRSSLPRQQPYILPPVHVQCGEHYSETHTSQDSIFHGNEEALYCNSHNSLDLNYLNGTVTNGSVCSVHSVNSLNCSQSFIQASPVSSNLSIPGSDIMRADYIPSHRHSAIIVPSYRPTPDYETVMRQMKRGILHTDSQSQSLRNLNIINTHAYNQPEDLVYSQPEMRERHPYTVPYGPQGVYSNKLVSPSDQRNPKNNVVPSKPGASAISHTVSTPELANMQLQGSHNYSTAHMLKNYLFRPPPPYPRPRPATSTPDLASHRHKYVSGSSPDLVTRKVQLSVKTFQEDSSPVVHQSLQEVSEPLTATKHHGTVNKRHSLEVMNSMVRGMEAMTLKSLHLPMARRNTLREQGPPEEGSGSHEVPQLPQYHHKKTFSDATMLIHSSESEEEEEEAPESVPQIPMLREKMEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRNLEKQKMAGLEAQKRPLMLAALNGLSVARVSGREENRVDATRVPMDERFRTLKKKLEEGMVFTEYEQIPKKKANGIFSTAALPENAERSRIREVVPYEENRVELIPTKENNTGYINASHIKVVVGGAEWHYIATQGPLPHTCHDFWQMVWEQGVNVIAMVTAEEEGGRTKSHRYWPKLGSKHSSATYGKFKVTTKFRTDSVCYATTGLKVKHLLSGQERTVWHLQYTDWPDHGCPEDVQGFLSYLEEIQSVRRHTNSMLEGTKNRHPPIVVHCSAGVGRTGVLILSELMIYCLEHNEKVEVPMMLRLLREQRMFMIQTIAQYKFVYQVLIQFLQNSRLI

SEQ ID NO: 186 - protein, 158 aa, Homo sapiens
MAEQATKSVLFVCLGNICRSPIAEAVFRKLVTDQNISENWVIDSGAVSDWNVGRSPDPRAVSCLRNHGIHTAHKARQITKEDFATFDYILCMDESNLRDLNRKSNQVKTCKAKIELLGSYDPQKQLIIEDPYYGNDSDFETVYQQCVRCCRAFLEKAH

SEQ ID NO: 187 - protein, 223 aa, Homo sapiens
MEDVKLEFPSLPQCKEDAEEWTYPMRREMQEILPGLFLGPYSSAMKSKLPVLQKHGITHIICIRQNIEANFIKPNFQQLFRYLVLDIADNPVENIIRFFPMTKEFIDGSLQMGGKVLVHGNAGISRSAAFVIAYIMETFGMKYRDAFAYVQERRFCINPNAGFVHQLQEYEAIYLAKLTIQMMSPLQIERSLSVHSGTTGSLKRTHEEEDDFGTMQVATAQNG

We claim:

1. A method of categorizing cancers, comprising:
testing and identifying a somatic mutation in the coding sequence for protein tyrosine phosphatase family member PTPRT in a sample of a human cancer tissue selected from the group consisting of colorectal, gastric, and lung;
assigning the human cancer tissue to a group based on the presence or absence of the somatic mutation, wherein the somatic mutation in protein kinase family member PTPRT is T1368M.

2. A method of categorizing cancers, comprising:
testing and identifying a somatic mutation in the coding sequence for protein tyrosine phosphatase family member PTPRT in a sample of a human cancer tissue selected from the group consisting of gastric and lung;
assigning the human cancer tissue to a group based on the presence or absence of the somatic mutation, wherein the somatic mutation in protein kinase family member PTPRT is selected from the group consisting of A209T, V1269M, F248S, Y280H, Y412F, N510K, T605M, V648G, R632X, A707T, D927G, A707V, R1021X, F74S, L708P, R975X, LOH, Q987K, A1118P, N11281, R1212W, M1259L, 1395V, Y1351F, R453c, K218T, R1346L, and R790I.

3. A method of categorizing cancers, comprising:
testing and identifying a somatic mutation in the coding sequence for protein tyrosine phosphatase family member PTPRT in a sample of a human colorectal cancer tissue, wherein the somatic mutation is selected from the group consisting of A209T, V1269M, F248S, Y280H, Y412F, N510K, T605M, V648G, R632X, A707T, D927G, A707V, R1021X, F74S, L708P, R975X, LOH, Q987K, A1118P, T1368M, N11281, R1212W, M1259L, 1395V, Y1351F, R453c, K218T, R1346L, and R790I; and
assigning the human cancer tissue to a group based on the presence or absence of the somatic mutation.

4. A method of categorizing cancers, comprising:
testing and identifying a somatic mutation in the coding sequence for protein tyrosine phosphatase family member PTPRT in a sample of a human colorectal cancer tissue, wherein the somatic mutation is selected from the group consisting of A209T, V1269M, F248S, Y280H, Y412F, N510K, T605M, V648G, R632X, A707T, D927G, A707V, R1021X, F74S, L708P, R975X, LOH, Q987K, A1118P, T1368M, N11281, R1212W, M1259L, 1395V, Y1351F, R453c, K218T, R1346L, and R790I; and
assigning the human cancer tissue to a group based on the presence or absence of the somatic mutation, wherein the group is used to identify cancer.

5. The method of claim 3 wherein the step of identifying the somatic mutation comprises sequencing the coding sequence of PTPRT.

6. A method of identifying cancer cells in a sample collected from a human, comprising:
determining sequence of one or more exons in the coding sequence of protein tyrosine phosphatase family member PTPRT in a sample collected from the human, wherein the sample is a suspected cancer tissue selected from the group consisting of colorectal, gastric, and lung;
identifying a somatic mutation of said protein tyrosine phosphatase family member in the suspected cancer tissue;
identifying the sample as containing cancer cells if a somatic mutation is identified, wherein the somatic mutation in protein kinase family member PTPRT is selected from the group consisting of A209T, V1269M, F248S, Y280H, Y412F, N510K, T605M, V648G, R632X, A707T, D927G, A707V, R1021X, F74S, L708P, R975X, LOH, Q987K, A1118P, N11281, R1212W, M1259L, 1395V, Y1351F, R453c, K218T, R1346L, and R790I.

7. A method of identifying cancer cells in a sample collected from a human, comprising:
determining sequence of one or more exons in the coding sequence of protein tyrosine phosphatase family member PTPRT in a sample collected from the human, wherein the sample is a suspected cancer tissue selected from the group consisting of colorectal, gastric, and lung;
identifying a somatic mutation of said protein tyrosine phosphatase family member in the suspected cancer tissue;
identifying the sample as containing cancer cells if a somatic mutation is identified, wherein the somatic mutation is T1368M.

8. The method of claim 3 wherein the step of identifying comprises amplifying one or more exons of PTPRT.

9. The method of claim 3 wherein the step of identifying comprises determining sequence of one or more exons of PTPRT using dye terminator chemistry.

10. The method of claim 3 wherein the step of identifying comprises determining coding sequence of PTPRT in normal tissue, wherein the normal tissue and the colorectal cancer tissue are obtained from the same patient.

11. The method of claim 3 wherein the step of identifying comprises determining nucleotide sequence of one or more exons of PTPRT in a normal tissue, wherein the normal tissue and the cancer tissue are from the same patient.

* * * * *

UNITED STATES PATENT AND TRADEMARK OFFICE
CERTIFICATE OF CORRECTION

| | | |
|---|---|---|
| PATENT NO. | : 8,039,210 B2 | Page 1 of 1 |
| APPLICATION NO. | : 11/596349 | |
| DATED | : October 18, 2011 | |
| INVENTOR(S) | : Zhenghe Wang et al. | |

It is certified that error appears in the above-identified patent and that said Letters Patent is hereby corrected as shown below:

Column 11, Claim 2, Line 23:
    Please delete "1395V" and insert -- I395V --

Column 11, Claim 2, Line 23:
    Please delete "R453c" and insert -- R453C --

Column 11, Claim 3, Line 33:
    Please delete "1395V" and insert -- I395V --

Column 11, Claim 3, Line 33:
    Please delete "R453c" and insert -- R453C --

Column 11, Claim 4, Line 46:
    Please delete "1395V" and insert -- I395V --

Column 11, Claim 4, Line 46:
    Please delete "R453c" and insert -- R453C --

Column 12, Claim 6, Line 21:
    Please delete "1395V" and insert -- I395V --

Column 12, Claim 6, Line 21:
    Please delete "R453c" and insert -- R453C --

Signed and Sealed this
Nineteenth Day of June, 2012

David J. Kappos
*Director of the United States Patent and Trademark Office*